United States Patent
Oh et al.

(10) Patent No.: US 11,046,749 B2
(45) Date of Patent: Jun. 29, 2021

(54) CHIMERA PROTEIN COMPRISING FVIII AND VWF FACTORS, AND USE THEREOF

(71) Applicant: MOGAM INSTITUTE FOR BIOMEDICAL RESEARCH, Yongin-si (KR)

(72) Inventors: Injae Oh, Yongin-si (KR); Seung-Hoon Lee, Yongin-si (KR); Eui-Cheol Jo, Yongin-si (KR); Mee Sook Oh, Yongin-si (KR); Jae Hwan Ryu, Yongin-si (KR); Yong Jae Kim, Yongin-si (KR); So Ra Kim, Yongin-si (KR); Jin-hyun Park, Yongin-si (KR)

(73) Assignee: MOGAM INSTITUTE FOR BIOMEDICAL RESEARCH, Yongin-si (KR)

(*) Notice: Subject to any disclaimer, the term of this patent is extended or adjusted under 35 U.S.C. 154(b) by 42 days.

(21) Appl. No.: 16/312,589

(22) PCT Filed: Jun. 23, 2017

(86) PCT No.: PCT/KR2017/006655
§ 371 (c)(1),
(2) Date: Dec. 21, 2018

(87) PCT Pub. No.: WO2017/222337
PCT Pub. Date: Dec. 28, 2017

(65) Prior Publication Data
US 2019/0330311 A1   Oct. 31, 2019

Related U.S. Application Data

(60) Provisional application No. 62/354,255, filed on Jun. 24, 2016.

(51) Int. Cl.
| C07K 14/755 | (2006.01) |
| C12N 9/64 | (2006.01) |
| C12N 15/62 | (2006.01) |
| A61K 38/36 | (2006.01) |
| A61P 7/00 | (2006.01) |
| A61K 38/00 | (2006.01) |

(52) U.S. Cl.
CPC .............. *C07K 14/755* (2013.01); *A61P 7/00* (2018.01); *C12N 9/64* (2013.01); *C12N 15/62* (2013.01); *A61K 38/00* (2013.01)

(58) Field of Classification Search
None
See application file for complete search history.

(56) References Cited

U.S. PATENT DOCUMENTS

| 5,112,950 | A | 5/1992 | Meulien et al. |
| 8,173,597 | B2 | 5/2012 | Schwarz et al. |
| 8,759,293 | B2 | 6/2014 | Barnett |
| 8,802,620 | B2 | 8/2014 | Chtourou et al. |
| 9,018,166 | B2 | 4/2015 | Behrens et al. |
| 2013/0024960 | A1 | 1/2013 | Nathwani et al. |
| 2014/0249086 | A1 | 9/2014 | Horn et al. |
| 2015/0023959 | A1 | 1/2015 | Chhabra et al. |
| 2015/0266943 | A1 | 9/2015 | Chhabra et al. |
| 2016/0200794 | A1 | 7/2016 | Metzner et al. |

FOREIGN PATENT DOCUMENTS

| JP | 2011-523663 A | 8/2011 |
| JP | 2015-509365 A | 3/2015 |
| JP | 2015-83608 A | 4/2015 |
| KR | 10-2014-0084208 A | 7/2014 |
| KR | 10-2014-0115347 A | 9/2014 |
| KR | 10-2015-0144803 A | 12/2015 |
| WO | 2008/060780 A2 | 5/2008 |
| WO | 2009/149303 A1 | 12/2009 |
| WO | 2011/069164 A2 | 6/2011 |
| WO | 2013/123457 A1 | 8/2013 |
| WO | 2014/210558 A1 | 12/2014 |
| WO | 2015/106052 A1 | 7/2015 |

OTHER PUBLICATIONS

International Search Report of PCT/KR2017/006655 dated Sep. 20, 2017.

*Primary Examiner* — Marsha Tsay
(74) *Attorney, Agent, or Firm* — Sughrue Mion, PLLC

(57) ABSTRACT

A chimera protein according to the present application has a significantly increased in vivo half-life when administered because of a vWF domain coupled to FVIII, such that when used as a hemophilia A therapeutic agent, convenience for patients can be increased and medical expenses can be reduced.

15 Claims, 10 Drawing Sheets
Specification includes a Sequence Listing.

[Fig.1]
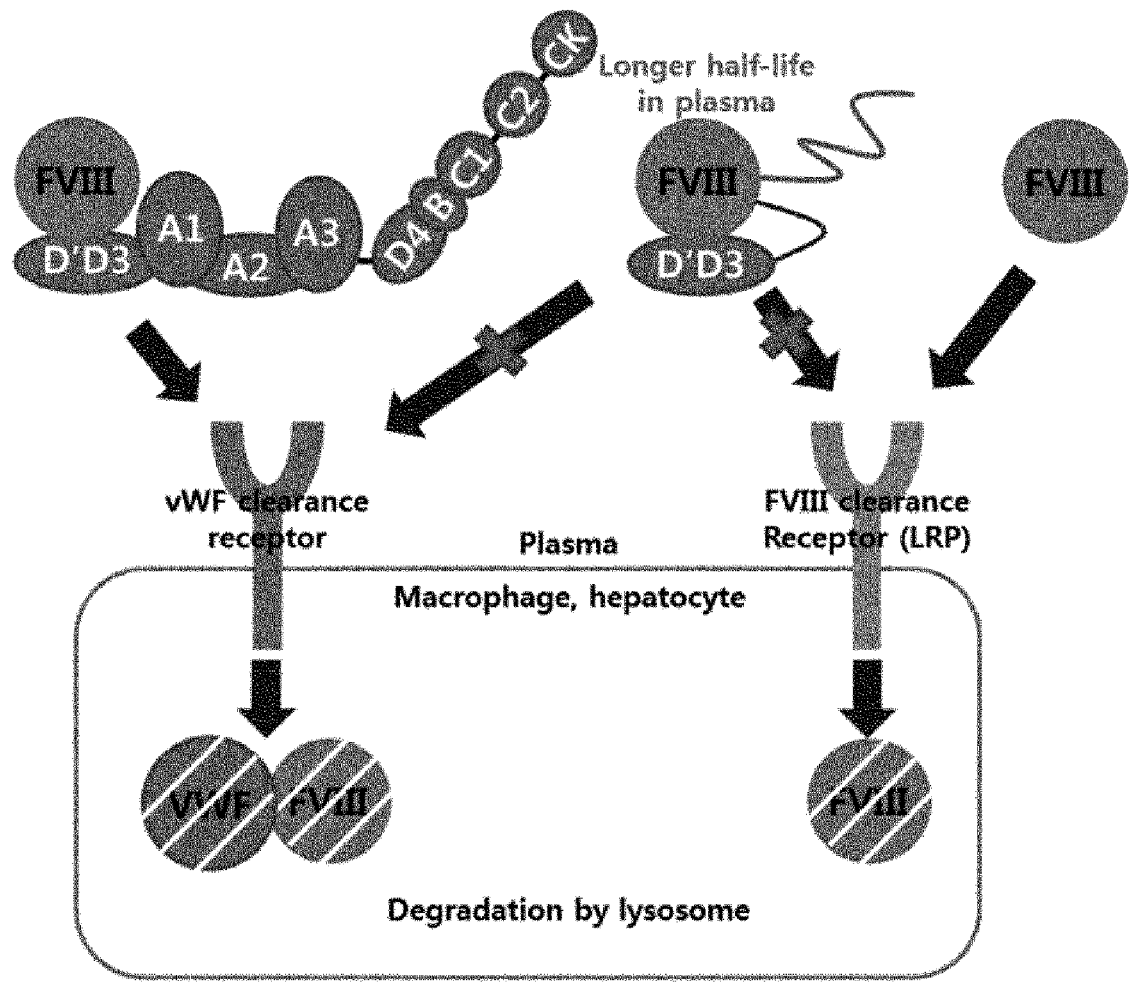

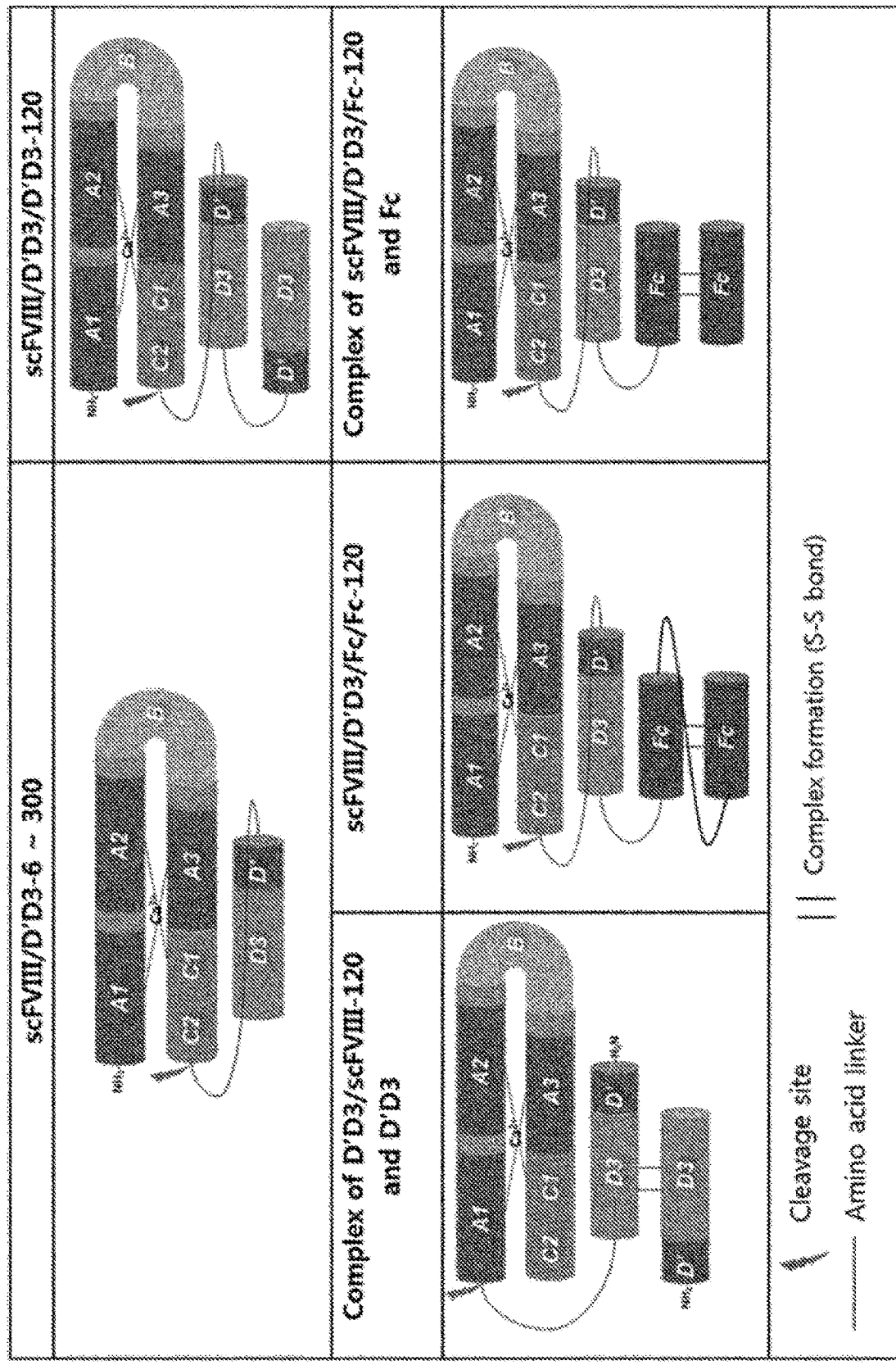
[Fig. 2a]

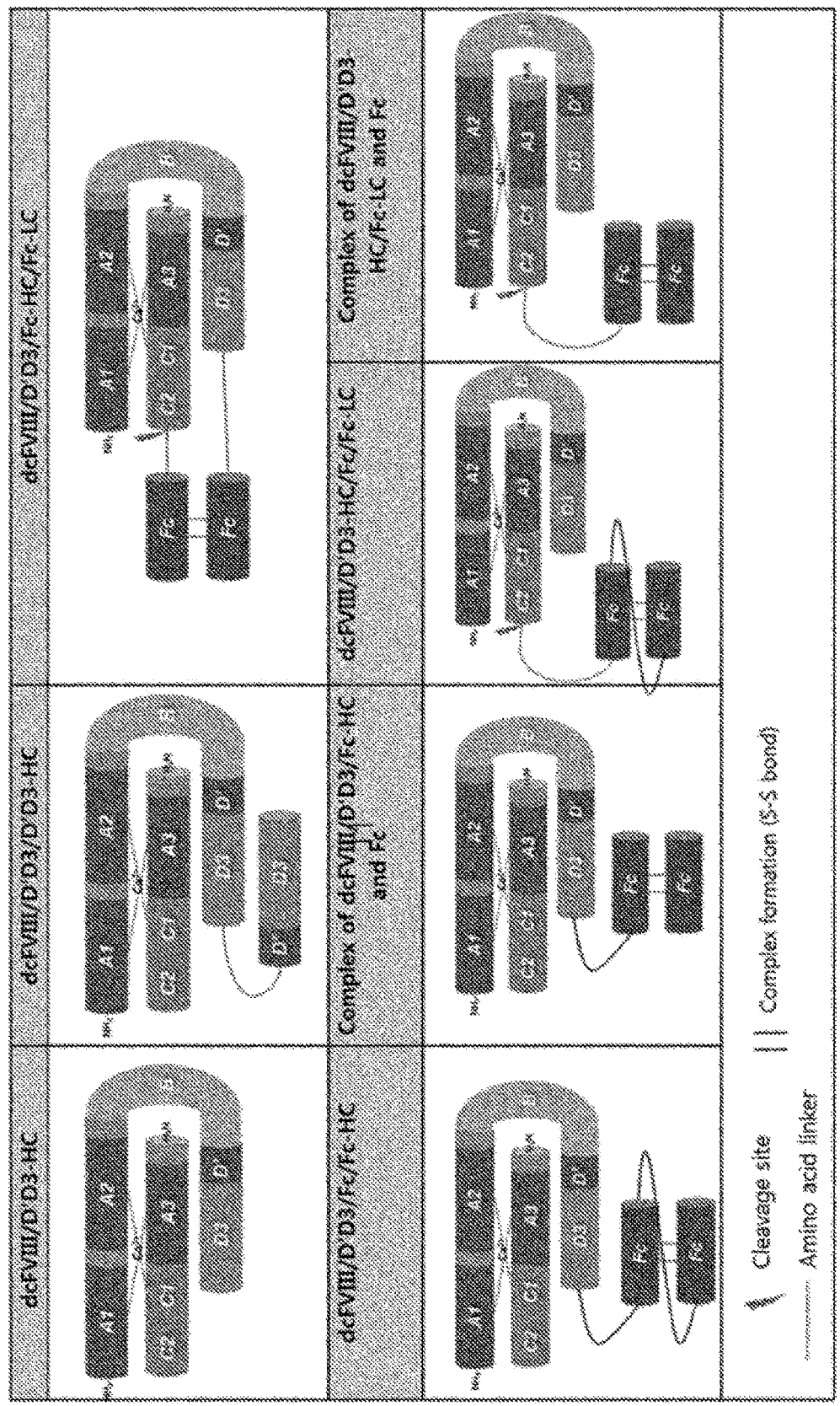
[Fig. 2b]

[Fig. 3]
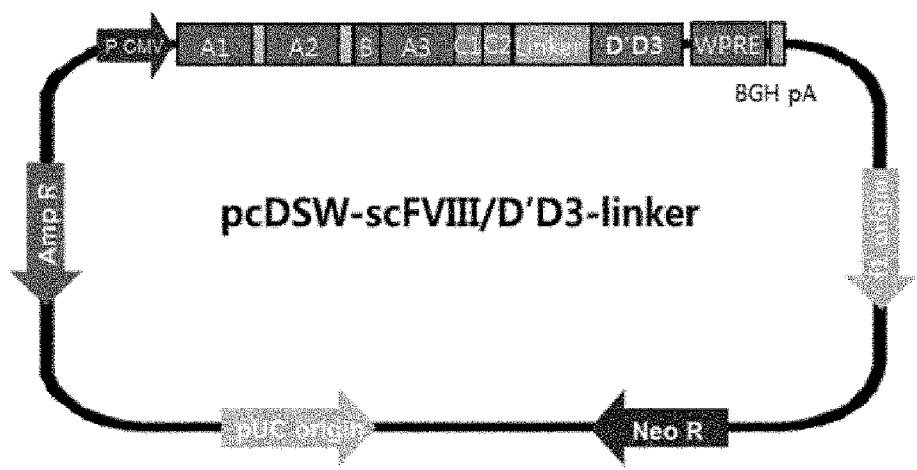
[Fig. 4]
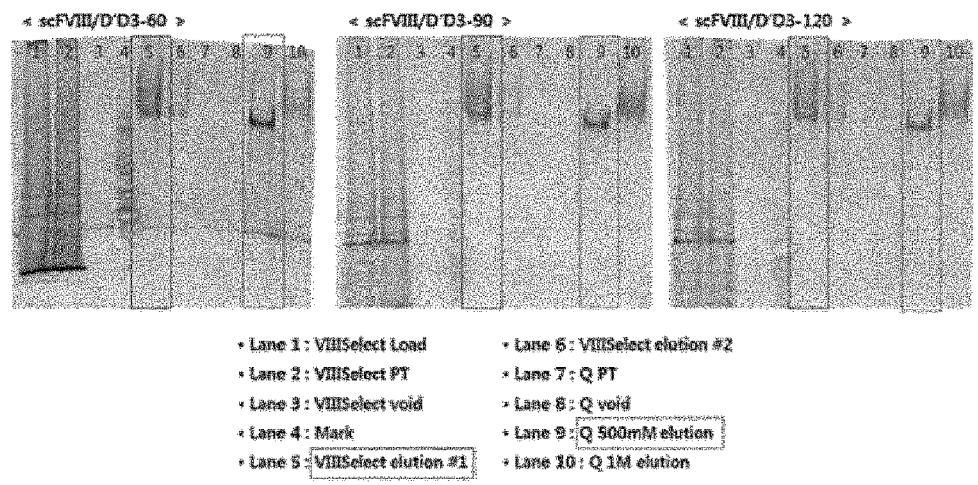
- Lane 1 : VIIISelect Load
- Lane 2 : VIIISelect PT
- Lane 3 : VIIISelect void
- Lane 4 : Mark
- Lane 5 : VIIISelect elution #1
- Lane 6 : VIIISelect elution #2
- Lane 7 : Q PT
- Lane 8 : Q void
- Lane 9 : Q 500mM elution
- Lane 10 : Q 1M elution
[Fig. 5]
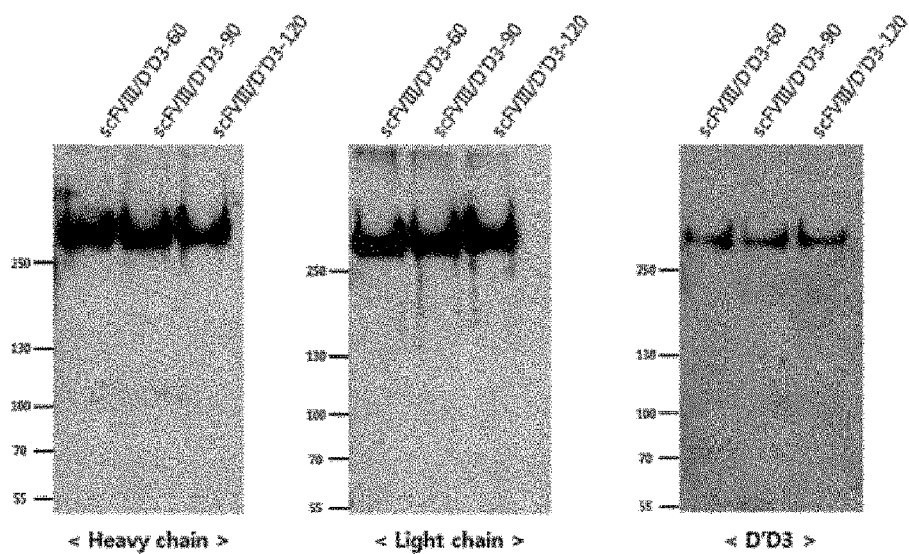
< Heavy chain >   < Light chain >   < D'D3 >

[Fig. 6]
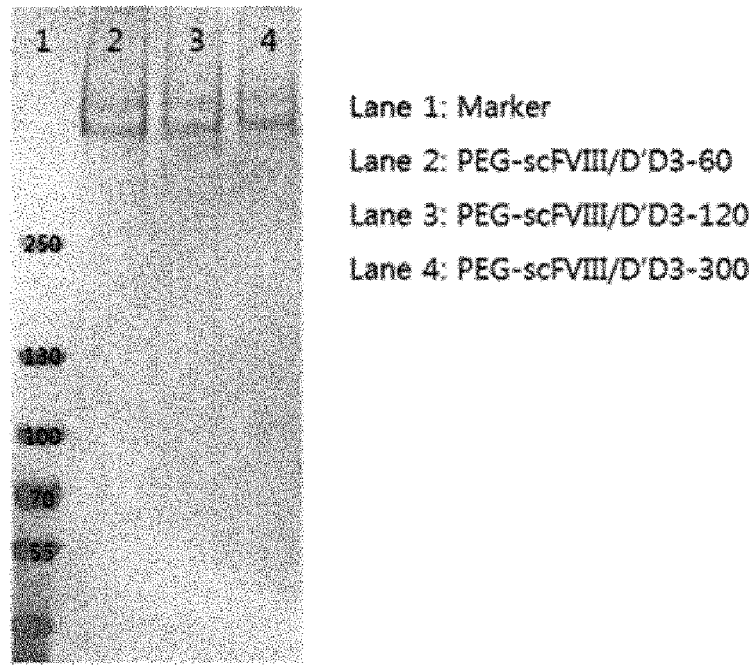
Lane 1: Marker
Lane 2: PEG-scFVIII/D'D3-60
Lane 3: PEG-scFVIII/D'D3-120
Lane 4: PEG-scFVIII/D'D3-300
[Fig. 7]
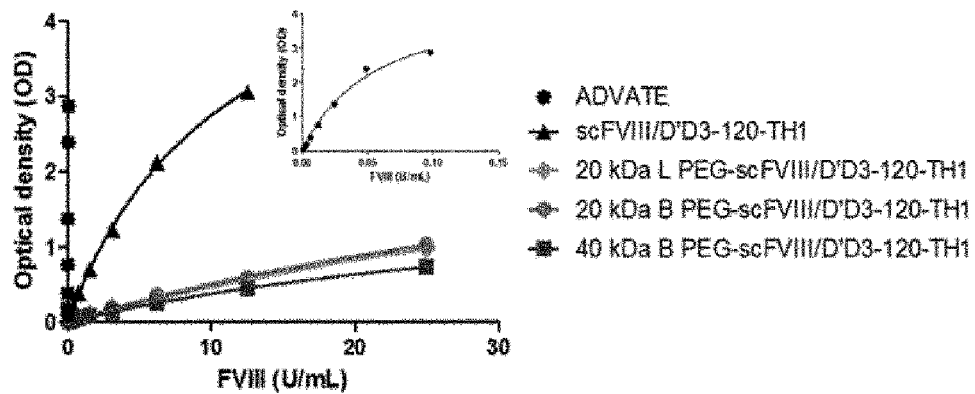
- ADVATE
- scFVIII/D'D3-120-TH1
- 20 kDa L PEG-scFVIII/D'D3-120-TH1
- 20 kDa B PEG-scFVIII/D'D3-120-TH1
- 40 kDa B PEG-scFVIII/D'D3-120-TH1
[Fig. 8]
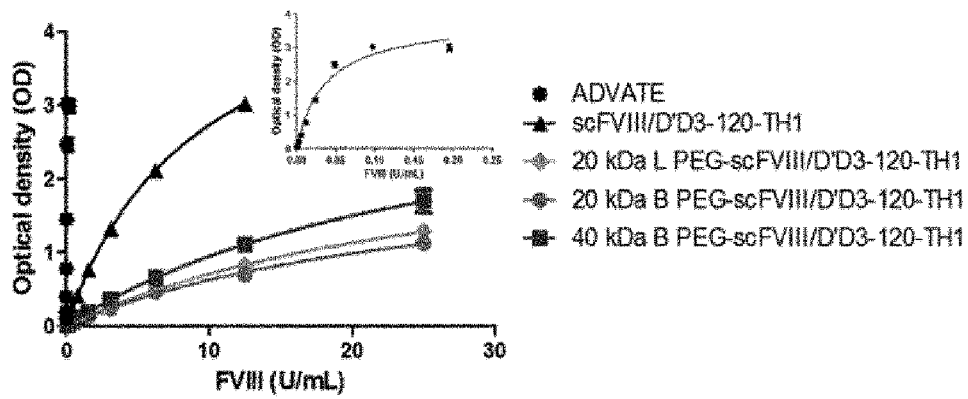
- ADVATE
- scFVIII/D'D3-120-TH1
- 20 kDa L PEG-scFVIII/D'D3-120-TH1
- 20 kDa B PEG-scFVIII/D'D3-120-TH1
- 40 kDa B PEG-scFVIII/D'D3-120-TH1

[Fig. 9]
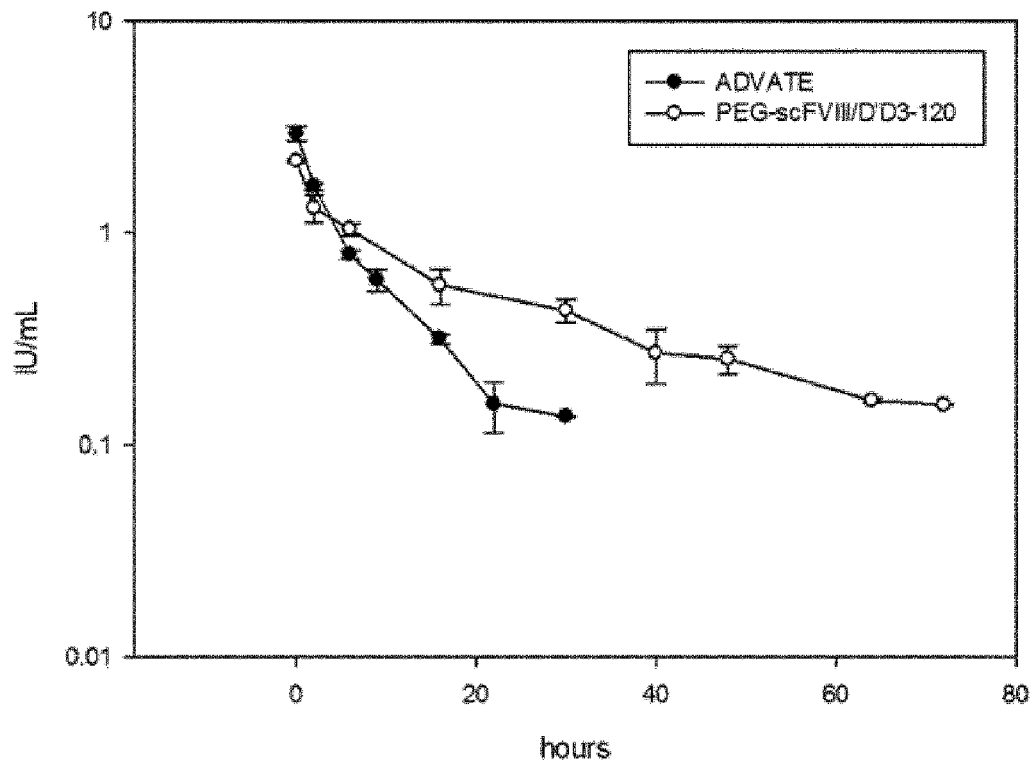
[Fig. 10]
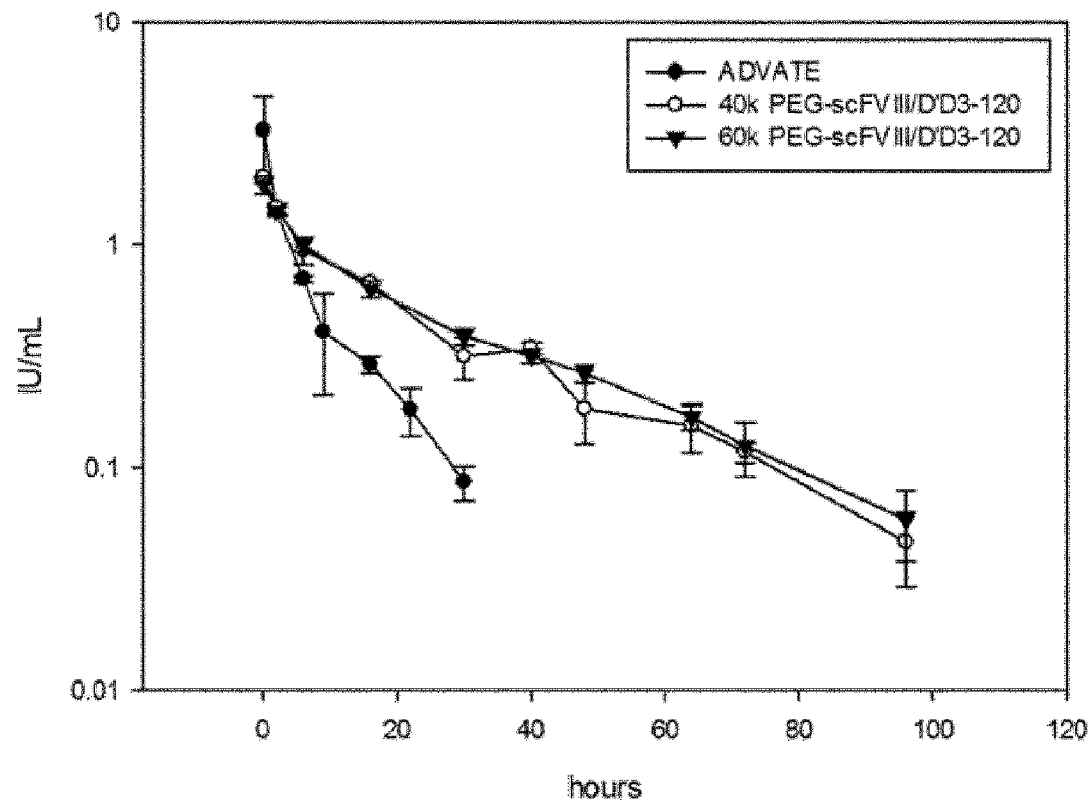

[Fig. 11]
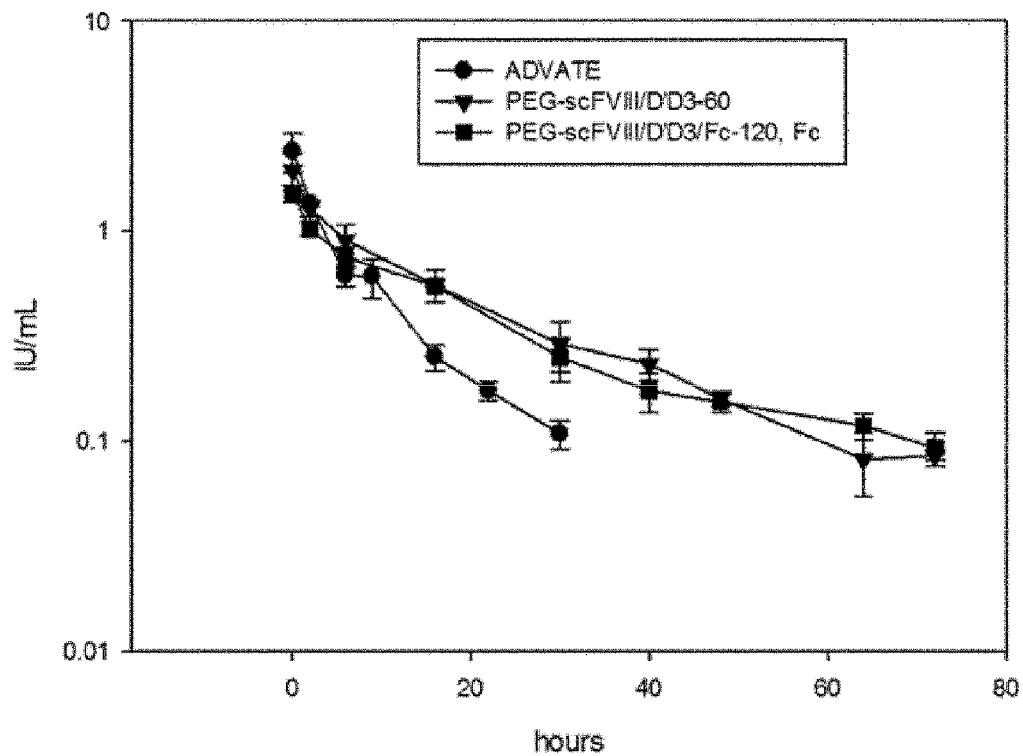
[Fig. 12]
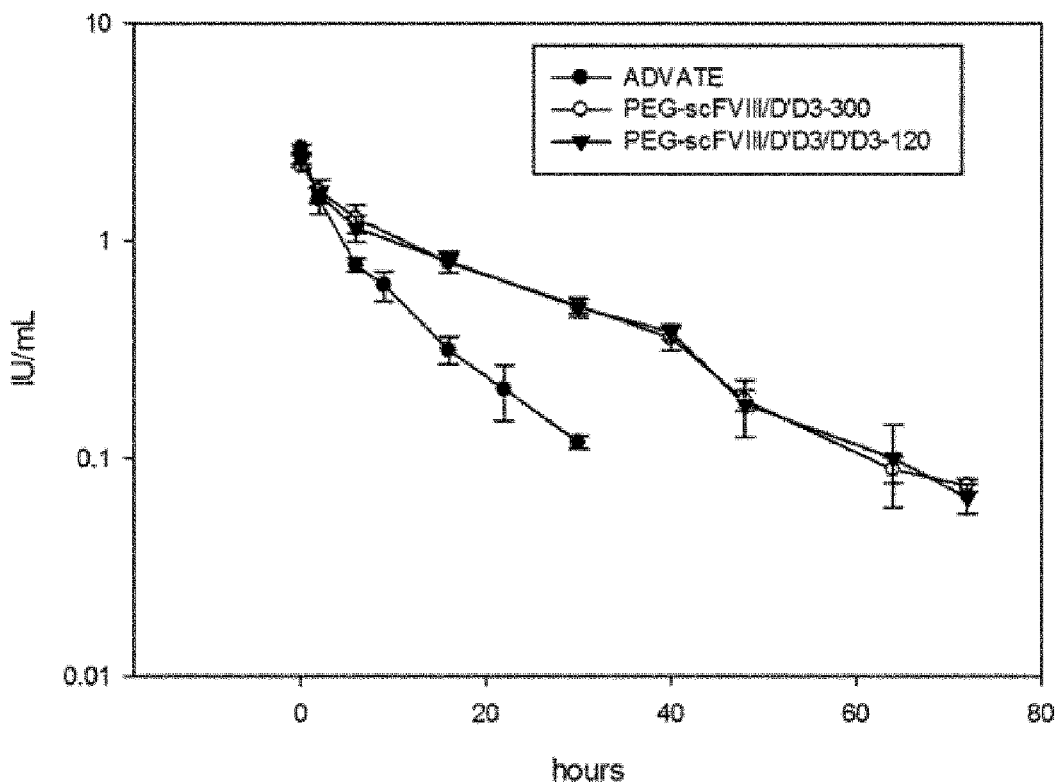

[Fig. 13]
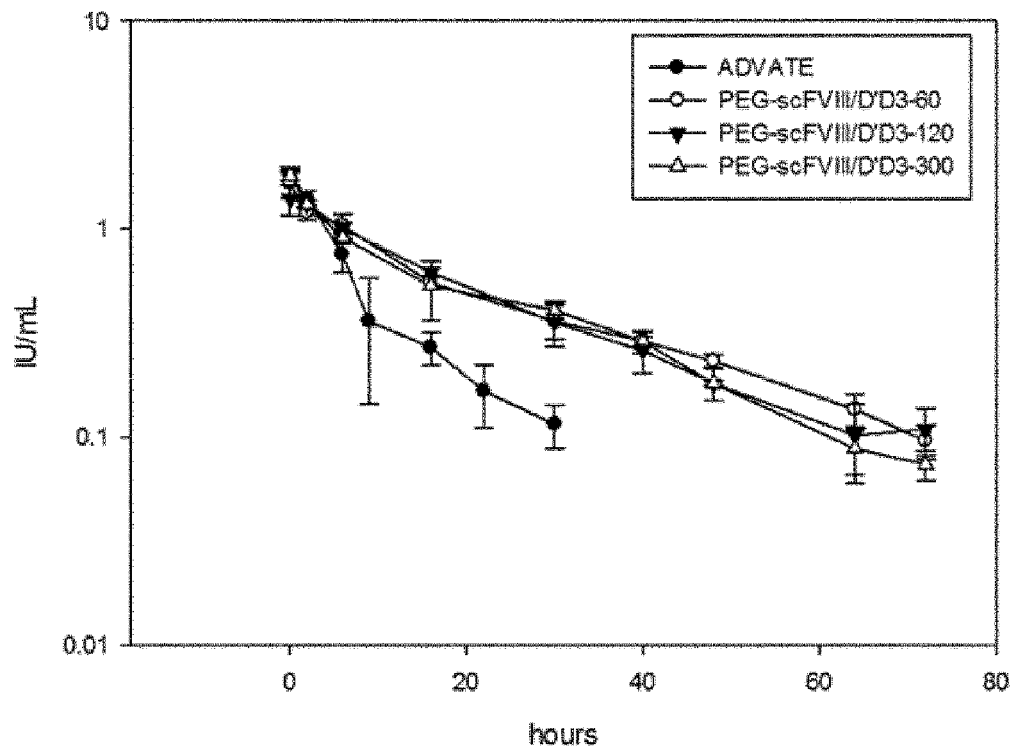
[Fig. 14]
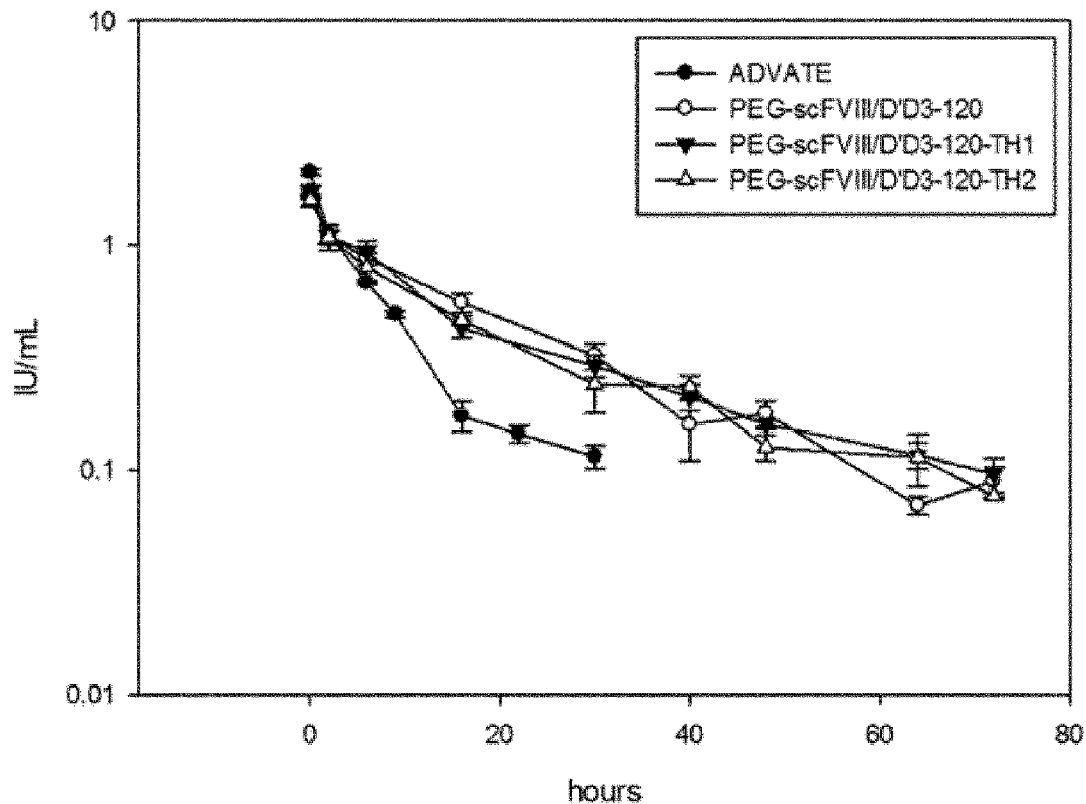

[Fig. 15]
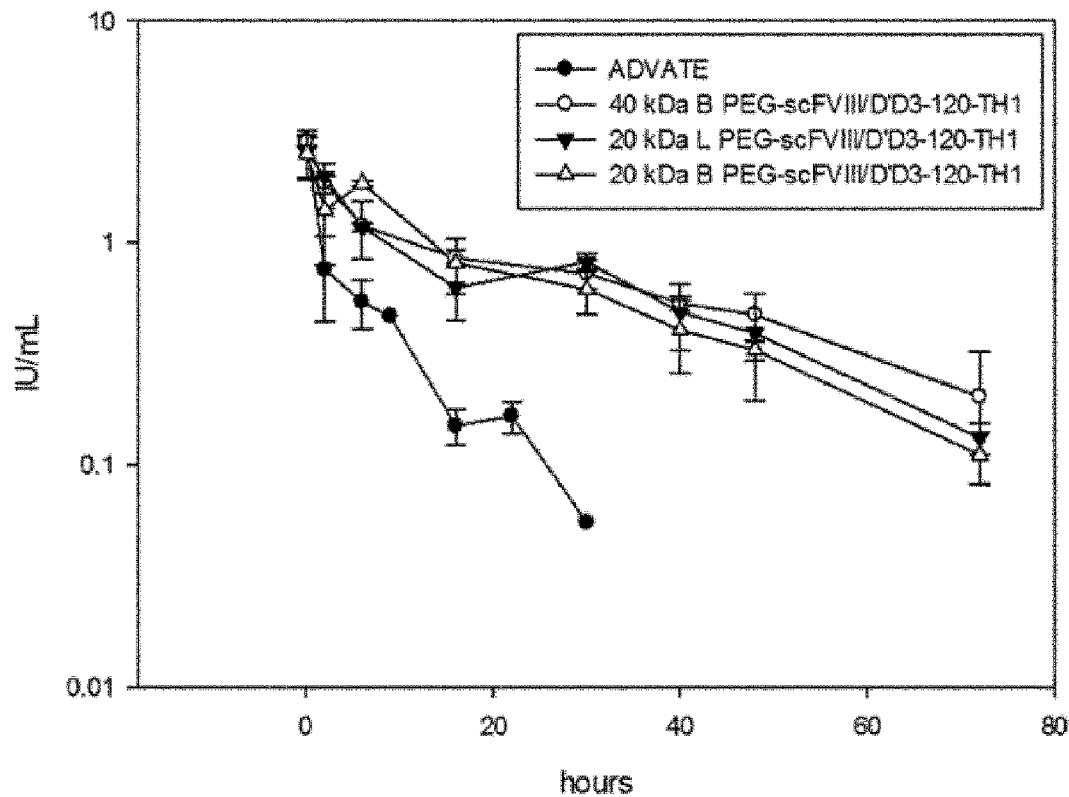
[Fig. 16]
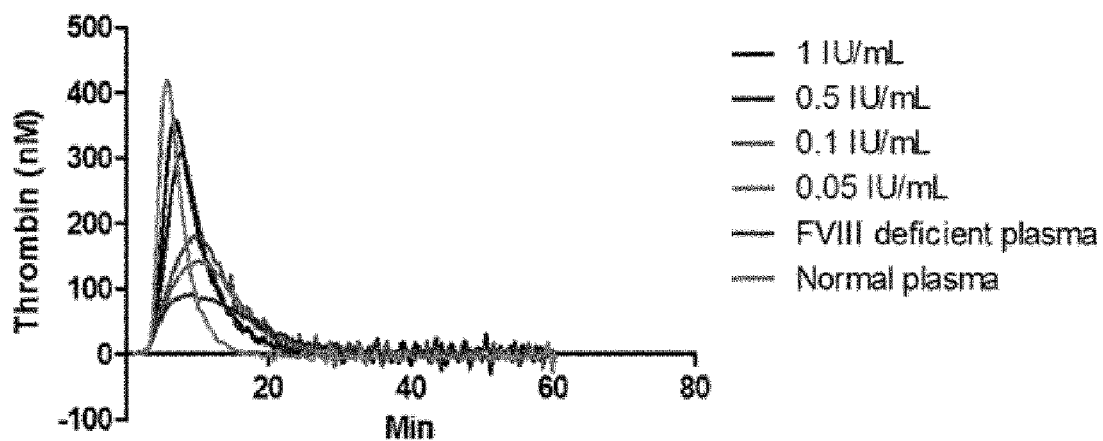

[Fig. 17]
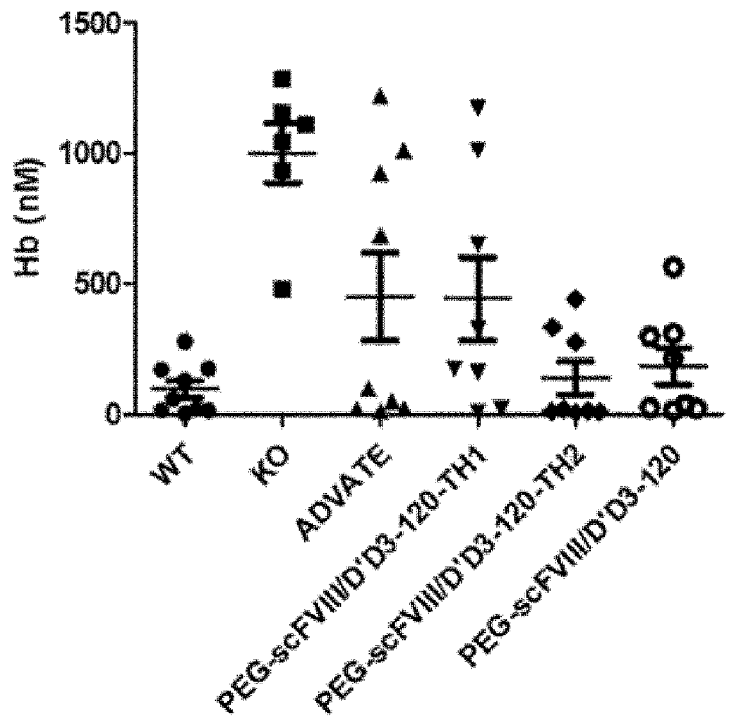
[Fig. 18]
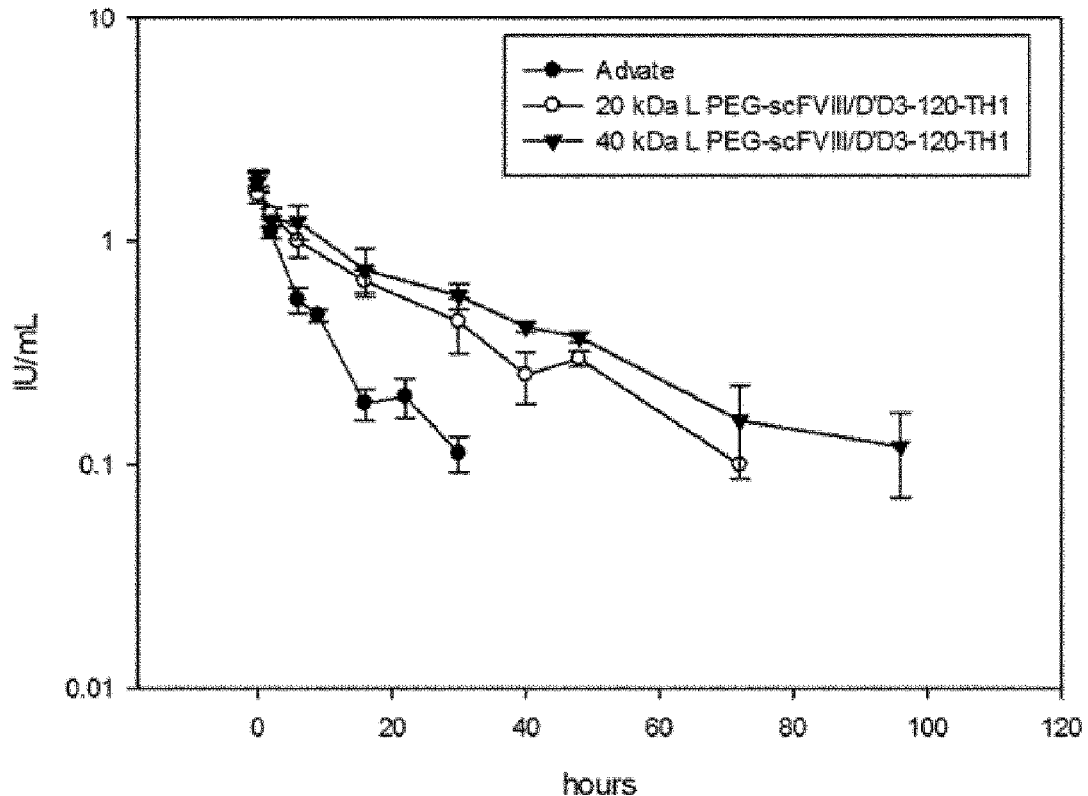

CHIMERA PROTEIN COMPRISING FVIII AND VWF FACTORS, AND USE THEREOF

TECHNICAL FIELD

The present invention relates to a recombinant Factor VIII used in the treatment of hemophilia.

CROSS REFERENCE TO RELATED APPLICATIONS

This application is a National Stage of International Application No. PCT/KR2017/006655 filed Jun. 23, 2017, claiming priority based on U.S. Provisional Patent Application No. 62/354,255 filed Jun. 24, 2016.

BACKGROUND ART

Hemophilia is a disease in which bleeding develops consecutively since hemostasis is not achieved due to the lack of coagulation factors. The coagulation factors in the blood are composed of I to XIII, and, among them, the factors related to hemophilia are VIII, IX and XI. Hemophilia is caused by the genetic defect of the above factor. Depending on the type of a deficient coagulation factor, hemophilia can be divided into hemophilia A in which Factor VIII is deficient, hemophilia B in which Factor IX is deficient, and hemophilia C in which Factor XI is deficient. And the hemophilia A accounts for about 80 to 85% of the hemophilia.

The drugs for administration vary depending on the type of hemophilia, and the doses and methods of administration for a type of hemophilia also vary depending on the administration site. However, the goal of hemophilia therapy is hemostasis, and treatment is conducted in two aspects, prophylaxis and on demand treatment, using the enzyme replacement therapy (ERT). Current therapies are showing the tendency of moving toward the prophylactic aspect.

As for the enzymes used for the ERT, FVIII (hemophilia A) and FIX (hemophilia B), which were extracted from whole blood and plasma and concentrated, were used in the past. However, when hemophilia factors are extracted from whole blood and plasma, some of the blood of people infected with viruses such as AIDS and HBV were used, and adverse events and complications such as viral infection developed owing to insufficient removal of such viruses during the extraction process of the coagulation factors. And thus, recently, various factors produced by recombinant DNA technology have been developed and used. For example, various forms of FVIII are being developed, such as a complete form of FVIII, FVIII in which its B domain is deleted, and FVIII whose half-life has been increased through modification at specific residues.

When FVIII is used for a prophylactic therapy, the half-life in the blood of FVIII is as short as 12 hours (human), which is inconvenient since it should be administered once every 2-3 days. In addition, since such administration is I.V. administration, reduction in the frequency of administrations is important in terms of patient's convenience. Therefore, long-acting FVIII has recently been developed to increase the half-life of FVIII.

One of them is a FVIII-Fc fusion protein (FVIII-Fc) in which the Fc domain of an antibody is fused to the C-terminal of FVIII, and this substance uses a strategy of increasing its half-life using FcRn recycling. Several PEGylated FVIIIs have been disclosed, in which PEG (polyethylene glycol) is conjugated around the binding site to LRP (low density lipoprotein receptor related protein), which is known to be responsible for the clearance of FVIII in the body. However, the mean of the half-lives of these long-acting FVIIIs was 18 hours, which increased only by about 1.5-fold as compared to 12 hours of the conventional FVIII, which means that the frequency of administrations of 3-4 times a week in the case of the conventional FVIII decreased to 2-3 times a week. The reason why the half-lives of FVIII-Fc and PEGylated FVIII are not greatly increased is because FVIII is circulating in the blood in a state of strong non-covalent interaction with vWF in the blood. FVIII-Fc and PEGylated FVIII also tend to have non-covalent interaction with vWF present in the blood, and thus have the limitation that they are affected by the half-life of vWF to be converged to the half-life of vWF (12 hours) (Tiede A. Journal of Thrombosis and Haemostasis, 13 (Suppl. 1): S176-S179).

The therapeutic agents developed so far still have short intervals of administrations (intravenous injection) in terms of a functional aspect, and there is a problem of frequent bleeding due to the loss of effects in the body caused by the half-lives which are not long enough. Therefore, it is necessary to develop a long-acting FVIII with a half-life increased by 3-fold or more in order to reduce the administration frequency to once a week or less.

DISCLOSURE OF INVENTION

Technical Problem

An object of the present invention is to provide an improved FVIII that can be administered with the administration frequency of once a week or less owing to extended residence time in the body.

Solution to Problem

In one embodiment, the present invention provides a chimeric protein comprising a human Factor VIII (FVIII) comprising a light chain and a heavy chain, the human FVIII comprising a B domain which is totally deleted in its entire length or partially deleted, and at least one vWF D'D3 domain. The protein according to the present invention has a half-life extended by at least 2-fold.

In a chimeric protein according to the present invention, the light chain and heavy chain may be expressed as one polypeptide or as two polypeptides.

According to the present invention, if the light chain and heavy chain are expressed as one polypeptide, the FVIII is linked to the vWF D'D3 domain, and the chimeric protein comprises a linker which has an enzyme cleavage site located therebetween, wherein the N-terminal of the vWF D'D3 domain is located in the N-terminal or C-terminal direction based on the linker, or the FVIII and the vWF D'D3 domain are located in the N-terminal direction and the C-terminal direction or in the C-terminal direction and the N-terminal direction, respectively, based on the linker. In one embodiment, for example, they may be arranged in the order of FVIII-linker-D'D3 or D'D3-linker-FVIII in the N to C direction.

According to the present invention, if the light chain and heavy chain are expressed as two polypeptides, the N-terminal of the vWF D'D3 domain may be linked to the C-terminal of the B domain comprised in the heavy chain.

In one embodiment, the partially deleted B domain has at least five amino acid deletions in each of the N-terminal direction and/or C-terminal direction based on the 1648 and 1649 residue positions of SEQ ID NO: 01, the deletion including the residues; or the B domain is partially deleted such that it includes at least 4 glycation sites, or 4 to 6 glycation sites.

In another embodiment, a B domain which can be included in the partially deleted B domain of the present invention is represented by a sequence of amino acid residues 741 to 902 and 1654 to 1689, or amino acid residues 741 to 936, based on the sequence of SEQ ID NO: 01.

In another embodiment, the chimeric protein according to the present invention further comprises at least one Fc, wherein the Fc may be linked to the vWF D'D3 domain and/or the FVIII.

In another embodiment according to the present invention, the chimeric protein according to the present invention may further comprise two or more vWF D'D3 domains and/or two or more Fcs. Herein, among a plurality of vWF D'D3 domains and among a plurality of Fcs, they may be linked to one another by linkers with or without an enzyme cleavage site, and/or they may form complexes by a covalent bond(s) among one another, for example, dimers can be formed if two of them are included. For the enzyme cleavage sites and linkers used herein, reference can be made to those described herein.

In another embodiment, if a linker comprising an enzyme cleavage site is used in a chimeric protein according to the present invention, the enzyme cleavage site is a sequence which can be cleaved by thrombin, FVIIa, FXa or FXIa; and the other sequence in the linker having the enzyme cleavage site is represented by the amino acid sequence of $[G_4S]_n$, wherein n is 0, or an integer between 1 and 100, in particular, n is 4, 6, 8, 10, 16, 21, 22, or 58.

In another embodiment, at the enzyme cleavage site included in the linker in the chimeric protein according to the present invention, the amino acid sequence which can be cleaved by the thrombin is DFLAEGGGVR (SEQ ID NO: 36), TTKIKPR (SEQ ID NO: 37), or LVPRGS (SEQ ID NO: 38); the amino acid sequence which can be cleaved by the FVIIa is ASKPQGRIVGG (SEQ ID NO:39); the amino acid sequence which can be cleaved by FXa is IDGR (SEQ ID NO: 40) or IEGR (SEQ ID NO: 41); the sequence which can be cleaved by FXIa can be represented by SKLTRAETVF (SEQ ID NO: 42).

In another embodiment, the chimeric protein according to the present invention is expressed in the form of first and second polypeptides, wherein the first polypeptide comprises the heavy chain and all or a portion of the B domain of the FVIII, and the second polypeptide comprises the light chain or a portion of the B domain of the FVIII; and the vWF D'D3 domain is located in the N-terminal or C-terminal direction of the first polypeptide, or in the N-terminal or C-terminal direction of the second polypeptide. If the vWF D'D3 domain is linked to the C-terminal of the first polypeptide or the C-terminal of the second polypeptide, it has a structure similar to that in which the vWF D'D3 domain is linked to the N-terminal or the C-terminal of scFVIII, and in these cases, the difference is whether FVIII is a single chain or a two chain.

In one embodiment, when expressed in the form of first and second polypeptides, the vWF D'D3 domain is located in the C-terminal direction of the first polypeptide.

The chimeric protein according to the present invention may comprise one or more, specifically, two vWF D'D3 domains, and may form a complex (dimer) between the vWF D'D3 domains.

Optionally, the chimeric protein according to the present invention further comprises at least one, specifically two Fcs, wherein the Fc can be linked to the vWF D'D3 domain and/or the second polypeptide. A complex (dimer) can be formed between the Fcs.

In one embodiment, in the chimeric protein according to the present invention, the Fc or the vWF D'D3 domain is linked by a linker with or without an enzyme cleavage site.

In one embodiment, when a chimeric protein according to the present invention is expressed as one polypeptide, the amino acid sequence represented by SEQ ID NOs: 6, 7, 8, 9, 10, 11, 12, 13, 14, 15, 16, 17, 18, 19, 21, or 25, or an amino acid sequence that is equivalent with respect to its biological function or has at least 90% homology to said amino acid sequence may be included in the present invention.

In another embodiment, when the chimeric protein according to the present invention is expressed as two polypeptides, the amino acid sequences represented by SEQ ID NOs: 4 and 5 (heavy chain and light chain, respectively), SEQ ID NOs: 23 and 24 (heavy chain and light chain, respectively), SEQ ID NOs: 26 and 27 (heavy chain and light chain, respectively), SEQ ID NOs: 28 and 29 (heavy chain and light chain, respectively), SEQ ID NOs: 30 and 31 (heavy chain and light chain, respectively), SEQ ID NOs: 32, and 33 (heavy chain and light chain, respectively), or SEQ ID NO: 34 and 35 (heavy chain and light chain, respectively), or an amino acid sequence that is equivalent with respect to its biological function or has at least 90% homology to said amino acid sequences may be included in the present invention.

The chimeric protein according to the present invention may be conjugated to a hydrophilic polymer at one or more amino acid residues of the A and/or B domain fragments of FVIII, and the conjugation position is at least one selected from the group consisting of amino acid residues 754, 781, 782, 788, 789, 825, and 897 based on the sequence of SEQ ID NO: 01 in the B domain, and at least one selected from the group consisting of amino acid residues 491, 495, 498 and 1806 based on the sequence of SEQ ID NO: 01 in the A domain, and the one or more residues at the conjugation position are substituted with cysteine for conjugation with the hydrophilic polymer.

In one embodiment, the hydrophilic polymer is polyethylene glycol, polyethylene oxide, or dextran.

In another embodiment, the hydrophilic polymer is polyethylene glycol (PEG), and the PEG for use has an average molecular weight of 20 kDa or more, specifically 40 kDa or 60 kDa.

In one embodiment, the chimeric protein according to the present invention is modified in the B domain fragment of FVIII, specifically at residue 782.

In another embodiment, the present invention provides a nucleic acid encoding the chimeric protein described above, a vector comprising the nucleic acid, and a cell containing the vector.

In still another embodiment, the present invention provides a use of a chimeric protein, a nucleic acid encoding the same, a vector comprising the nucleic acid, and a cell comprising the vector.

The use of the present invention according to the present application includes a composition for treating hemophilia, a method for treating hemophilia, a blood coagulation composition, a blood coagulation method, or a method for producing a protein according to the present invention.

Advantageous Effects of Invention

The chimeric protein in which FVIII and a vWF domain are linked or the chimeric protein in a form of being modified by PEG according to the present invention has a highly increased half-life in the body when administered, thereby reducing the frequency of administrations of conventional agent of 2-4 times a week to less than once a week. And thus, such chimeric protein, as a therapeutic agent for hemophilia A, leads to the increase in convenience of a patient, and the reduction of a treatment cost.

BRIEF DESCRIPTION OF DRAWINGS

FIG. 1 is a schematic representation of the mechanism of increase of half-life of the recombinant FVIII with increased half-life according to the present invention. The first strategy is to mask the LRP binding site, which is known to have the greatest effect on the elimination of FVIII in the body, with PEG and D'D3, a domain of vWF. At the same time, the second strategy is covalent binding of D'D3, which is a domain of vWF, to the chimeric protein according to the present invention, to prevent binding of an endogenous vWF in the blood to the chimeric protein.

FIGS. 2a and 2b are schematic representations of various molecular structures of chimeric proteins expressed as a single chain (single polypeptide) and a double chain (double polypeptide) according to the present invention, respectively.

FIG. 3 is a schematic representation of a vector encoding a chimeric protein expressed as a single polypeptide according to one embodiment of the present invention.

FIG. 4 shows the results of the SDS-PAGE analysis after expression and purification of chimeric proteins comprising linkers of various lengths according to one embodiment of the present invention.

FIG. 5 shows the results of western blot analysis of chimeric proteins comprising linkers of various lengths according to one embodiment of the present invention with antibodies to the heavy chain, light chain and D'D3, respectively, and each antibody used was as follows: heavy chain: Green mountain, GMA-012; light chain: Abcam, 41188; and D'D3: Abcam, 96340.

FIG. 6 shows the results of the SDS-PAGE analysis after purification of the PEGylated chimeric proteins which were prepared by modification of scFVIII/D'D3-60, -120 and -300 by PEG according to an embodiment of the present invention.

FIG. 7 shows the results of vWF binding analysis of chimeric FVIII (scFVIII/D'D3-120-TH1) and PEGylated chimeric FVIII (PEG-scFVIII/D'D3-120-TH1) according to one embodiment of the present invention. Advate® was used as a comparative group.

FIG. 8 shows the results of LRP binding analysis of chimeric FVIII (scFVIII/D'D3-120-TH1) and PEGylated chimeric FVIII (PEG-scFVIII/D'D3-120-TH1) according to one embodiment of the present invention. Advate® was used as a comparative group.

FIG. 9 shows the results of PK analysis of the PEGylated chimeric FVIII (PEG-scFVIII/D'D3-120) prepared according to one embodiment of the present invention in HA mice. Advate® as a comparative group.

FIG. 10 shows the results of PK analysis of the PEGylated chimeric FVIII (40 kDa PEG-scFVIII/D'D3-120, 60 kDa PEG-scFVIII/D'D3-120) prepared according to one embodiment of the present invention in HA mice. Advate® was used as a comparative group.

FIG. 11 shows the PK results of the PEGylated chimeric FVIII (PEG-scFVIII/D'D3-60, PEG-scFVIII/D'D3/Fc-120, PEG-scFVIII/D'D3/Fc) prepared according to one embodiment of the present invention in HA mice. Advate® was used as a comparative group.

FIG. 12 shows the PK results of the PEGylated chimeric FVIII (PEG-scFVIII/D'D3-300, PEG-scFVIII/D'D3/D'D3-120) prepared according to one embodiment of the present invention in HA mice. Advate® was used as a comparative group.

FIG. 13 shows the PK results of the PEGylated chimeric FVIII (PEG-scFVIII/D'D3-60, PEG-scFVIII/D'D3-120, PEG-scFVIII/D'D3-300) prepared according to one embodiment of the present invention in HA mice. Advate® was used as a comparative group.

FIG. 14 shows the PK results of the PEGylated chimeric FVIII (PEG-scFVIII/D'D3-120, PEG-scFVIII/D'D3-120-TH1, PEG-scFVIII/D'D3-120-TH2) prepared according to one embodiment of the present invention in HA mice. Advate® was used as a comparative group.

FIG. 15 shows the PK results of the PEGylated chimeric FVIII (20 kDa linear PEG-scFVIII/D'D3-120-TH1, 20 kDa branch PEG-scFVIII/D'D3-120-TH1, 40 kDa branch PEG-scFVIII/D'D3-120-TH1) prepared according to one embodiment of the present invention. Advate® was used as a comparative group.

FIG. 16 shows the results of thrombin generation analysis of the PEGylated chimeric FVIII (PEG-scFVIII/D'D3-120-TH1) prepared according to one embodiment of the present invention.

FIG. 17 shows the results of the acute efficacy study in the tail clip model regarding the PEGylated chimeric FVIII (PEG-scFVIII/D'D3-120, PEG-scFVIII/D'D3-120-TH1, PEG-scFVIII/D'D3-120-TH2. Advate® was used as a comparative group.

FIG. 18 shows the PK results of the PEGylated chimeric FVIII (PEG-scFVIII/D'D3-120, PEG-scFVIII/D'D3-120-TH1, PEG-scFVIII/D'D3-120-TH2) prepared according to one embodiment of the present invention. Advate® was used as a comparative group.

BEST MODE FOR CARRYING OUT THE INVENTION

The present invention provides a technique for preventing or inhibiting FVIII from forming a complex with an endogenous vWF protein and at the same time inhibiting the binding of FVIII to LRP (low density lipoprotein receptor related protein) to extend the half-life of the FVIII protein. This results in a simultaneous reduction of vWF-dependent elimination along with delaying LRP and protease-dependent FVIII elimination, leading to an increased half-life.

Thus, in one embodiment, the present invention provides a chimeric protein in which human Factor VIII (Factor VIII or FVIII) and one or more vWF D'D3 domains are fused.

The chimeric protein according to the present invention can have a form of a single chain (sc) in which a light chain and a heavy chain of FVIII, which is composed of a light chain and a heavy chain in a wild form, are expressed as a single polypeptide, or it can have a form of dc (two chain) in which each of the light chain and heavy chain of FVIII is expressed as a separate polypeptide.

In one embodiment, the chimeric protein according to the present invention is embodied as a single chain (single polypeptide), wherein the vWF D'D3 domain is located in the N- or C-terminal direction of FVIII, and is linked by an amino acid linker having an enzyme cleavage site.

The chimeric protein according to the present invention is also embodied as a two chain (double polypeptides), wherein the vWF D'D3 domain can be linked in the N- or C-terminal direction of the heavy or light chain of FVIII. In one embodiment, it can be linked in the C-terminal direction of the B domain.

The FVIII protein that can be comprised in the chimeric protein according to the present invention may be of various lengths or origins, so long as it achieves the object according to the present invention through binding with vWF.

FVIII is composed of A1-A2-B-A3-C1-C2 domain and is synthesized in hepatocytes as a single chain protein. After synthesis, it is matured through processing to form a 280 kDa heterodimer composed of heavy and light chains. Among them, the light chain has a molecular weight of 80 kDa and is composed of A3-C1-C2 domain, and the heavy chain is composed of A1-A2-B domain and has a molecular weight of 90-200 kDa which varies greatly depending on the length of the B domain. The heterodimer is present in an inactivated state by binding to vWF in the blood, and when exposed to stimuli such as vascular injury, it is cleaved after arginine residue, that is, after the residues 372, 740 and 1689 based on the sequence of SEQ ID NO: 01, by thrombin. As a result, it is separated from vWF and activated to form a trimer of A1, A2 and A3-C1-C2. Then the trimer catalyzes the activation of FX by FIXa, and is rapidly decomposed.

The FVIII protein which can be comprised in the chimeric protein according to the present invention includes a full-length FVIII protein, a functional fragment thereof, a variant, an analogue or a derivative thereof, which has the function of a full-length wild-type FVIII Factor in the coagulation pathway. The term "FVIII protein" is used interchangeably with "FVIII polypeptide" or "FVIII". Examples of FVIII functions include, but are not limited to, the ability to activate blood coagulation, the ability to act as a cofactor for Factor IX, or the ability to form a tenase complex with Factor IX in the presence of $Ca^{2+}$ and phospholipids (thereafter, Factor X is transformed into an activated form Factor Xa).

Also, FVIII proteins of various origins may be used, e.g., FVIII proteins of humans, pig family, cat family, rat or chicken family. Non-limiting examples of FVIII amino acid and nucleic acid sequences may include GenBank NOs: NM_000132, NP_000123, 1012296 A, AAA52420.1, CAA25619.1, AAA52484.1, 1012298A, EAW72647.1, EAW72646.1, XP_001498954.1, ACK44290.1, AC095359.1, NP_001138980.1, ABZ10503.1, NP_032003.2 as disclosed.

In one embodiment according to the present invention, human FVIII is used, and for example, human FVIII can be represented by the sequence of SEQ ID NO: 01 (not including the signal peptide), and in the wild type sequence, the heavy chain is composed of the residues 1-740, the B domain is composed of the residues 741-1689 including a3 domain, and the light chain is composed of the residues 1690-2332.

Also, variants, derivatives, mutants, complexes or analogs of FVIII are also known in the art, which are included in the present invention. For example, U.S. Pat. No. 5,668,108 disclose a FVIII variant in which the aspartic acid at position 1241 is substituted with glutamic acid and has the attached nucleic acid changes; U.S. Pat. No. 5,149,637 describes a FVIII variant comprising a glycosylated or non-glycosylated C-terminal fragment; and U.S. Pat. No. 5,661,008 discloses a FVIII variant comprising amino acids 1-740 linked to amino acids 1649 to 2332 by at least three amino acid residues.

The FVIII which can be comprised in the chimeric protein according to the present invention includes FVIII in which its B domain is deleted, and examples of such FVIII include, but not limited to, the FVIII disclosed in U.S. Pat. Nos. 6,316,226, 6,346,513, 7,041,635, 5,789,203, 6,060,447, 5,595,886, 6,228,620, 5,972,885, 6,048,720, 5,543,502, 5,610,278, 5,171,844, 5,112,950, 4,868,112 and 6,458,563.

The FVIII which can be comprised in the chimeric protein according to the present invention includes FVIII in which its B domain is partially deleted, and such FVIII comprises a heavy chain and light chain, but some residues are deleted so as not to include cleavage sites of proteolytic enzymes such as furin.

In one embodiment, the partially deleted B domain includes a B domain which has at least five amino acid deletions in each of the N-terminal direction and C-terminal direction based on the 1648 and 1649 residue positions of SEQ ID NO: 01, the deletion including the residues, and/or a B domain which is partially deleted such that it includes 4 to 6 glycation sites In one embodiment, the FVIII which can be comprised in the chimeric protein according to the present invention has B domain deletion, and such partially deleted B domain includes the amino acid residues 741 to 902 and 1654 to 1689 based on the SEQ ID NO: 01.

In another embodiment, such partially deleted B domain includes the amino acid sequence of amino acid residues 741 to 902 and 1654 to 1689 based on the SEQ ID NO: 01, and includes a B domain in which some of the residues, specifically the isoleucin residue at position 782, are substituted with cysteine for modification by a hydrophilic polymer.

In another embodiment, the FVIII which can be comprised in the chimeric protein according to the present invention in which its B domain is deleted has an amino acid sequence represented by SEQ ID NO: 03 or an amino acid sequence having 90% or more homology thereto. The B domain comprised in the amino acid sequence of SEQ ID NO: 03 includes the residues 741 to 902 based on SEQ ID NO: 01.

The FVIII which can be comprised in the chimeric protein according to the present invention may be modified by conjugation with a hydrophilic polymer at some amino acid residues of the A domain and/or B domain fragment.

Specifically, in the present invention, for inhibiting LRP binding of a chimeric protein according to the present invention through modification, modifications can be conducted in a site-specific manner and at various positions to achieve the above object.

In one embodiment, the conjugation positions in a chimeric protein according to the present invention is at least one selected from the group consisting of the amino acid residues 491, 495, 498 and 1806 based on the sequence of SEQ ID NO: 01 in the A domain, and at least one selected from the group consisting of amino acid residues 754, 781, 782, 788, 789, 825, and 897 based on the sequence of SEQ ID NO: 01 in the B domain.

In another embodiment according to the present invention, the chimeric protein is PEGylated, specifically, at the B-domain, and specifically, at the positions mentioned above.

In another embodiment according to the present invention, the chimeric protein is modified at the 782 nd isoleucine residue of the B domain, specifically, it is pegylated, and for the pegylation, the residue may be substituted with cysteine or a cysteine group may be inserted as described below.

The hydrophilic polymer which may be used in the modification of FVIII according to the present invention may be a hydrophilic polymer known in the art so long as they achieve the object, and examples thereof may include, but not limited to, polyethylene glycol (PEG), polyethylene oxide, dextran.

In one embodiment according to the present invention, PEG is used, specifically, PEG which has a molecular weight of 20 kDa or more is used. According to the present invention, PEG binds near to the LRP binding region and serves the function of inhibiting the binding of FVIII with LRP by PEG hindrance. Therefore, if the length of PEG is too short, it may not provide enough hindrance, and it is important that the length is 20 kDa or more. In one embodiment, specifically, PEG having a molecular weight of 40 kDa, 60 kDa or more is used.

The PEG used in the PEGylation in the modification according to the present invention can be linked to a corresponding residue using a variety of functional groups known in the art.

In one embodiment according to the present invention, PEG is linked in a site-specific manner through a free-SH group present in residues such as cysteine, in which case PEG can be linked through, but not limited to, thiol, orthopyridyl disulfide, acryloyl, sulfone or maleimide groups.

In the FVIII according to the present invention, the residues to be linked to a hydrophilic polymer may be substituted or inserted for modification by a hydrophilic polymer, and the residues for substitution or insertion may vary depending on the substance used for modification, and suitable residues can be selected by a person of ordinary skill.

In one embodiment according to the present invention, PEGylation is used as a modification, in which case a residue for modification may be substituted with cysteine or the cysteine residue may be inserted in a suitable position.

In one embodiment according to the present invention, the isoleucin residue at position 782 of the B domain is modified, specifically PEGylated, and the residue is substituted with cysteine for PEGylation.

The PEGylation reaction can be carried out using known methods. For example, cysteine or glutathione used for masking free cysteine is removed prior to the PEGylation reaction so that the free thiol of the introduced cysteine is restored. The above process can be conducted including a step of treating with reduction agents such as TCEP, DTT, beta-mercaptoethanol, cysteine, and glutathione (reduced type), and an oxidation step for restoring the FVIII's original disulfide bond cleaved by reduction. Expression of a protein having substitution with cysteine for modification can be conducted using a method known in the art. For example, in the case of a PEGylated protein, since the introduced free cysteine forms a disulfide bond with cysteine or glutathione, which is a low molecular substance including thiol, during expression or after excretion out of a cell, it is necessary to increase the PEGylation efficiency by masking the free cysteine and stabilizing it until the PEGylation.

The chimeric protein according to the present invention comprises the vWF D'D3 domain.

vWF (also known as F8vWF) is a large multimeric glycoprotein present in the blood plasma and produced in the endothelium, in the Weibel-Palade bodies, megakaryocytes (alpha granules of platelets), and subendothelial connective tissue. The basic vWF monomer is composed of 2813 amino acids (including signal peptides), and every monomer contains a number of specific domains with specific functions, i.e., the D'/D3 domain (which binds to Factor VIII), the A1 domain (which binds to platelet GPIb-receptor, heparin, and/or possibly collagen), the A3 domain (which binds to collagen), the C1 domain (in which the RGD domain binds to platelet integrin αIIβ3 when this is activated), and the "cysteine knot" domain at the C-terminal of the protein. the cysteine knot is also found in platelet-derived growth factor (PDGF), transforming growth factor-β (TGF-β) and β-human chorionic gonadotropin (HCG).

Non-limiting examples of vWF amino acid sequences and nucleic acid sequences encoding vWF or a portion thereof include GenBank NO: NP_000543, NM_000552, AAE20723, AAB59512, P04275, EAW88815, ACP57027, EAW88816, and AAD04919; U.S. Pat. No. 5,260,274; Titani et al., Biochemistry, 25: 3171-84 (1986); and Sadler et al., PNAS, 82: 6391-6398 (1985), as disclosed.

For example, the amino acid sequence of full length human vWF is represented by SEQ ID NO: 02 (not including the signal peptide). The "propeptide" portion (D1-D2) of vWF is composed of the amino acid residue 1 to Arg-741 and the "mature" vWF protein is composed of the amino acid residue 742 to 2791, based on SEQ ID NO: 02. The individual domains can be represented as D': 742-842; D3: 843-1248; A1: 1249-1457; A2: 1458-1650; A3: 1651-1850; D4: 1851-2232; C1: 2233-2311; C2: 2312-2380; C3: 2407-2474; C4: 2475-2555; C5: 2556-2644; C6: 2625-2700 and CK: 2701-2791 (Lenting. P. J. BLOOD, 26 Mar. 2015. VOLUME 125, NUMBER 13). Or, by the EXPASY protein database nomenclature (worldwideweb.uniprot.org/uniprot/P04275) as the alternative vWF domain mapping and naming system, the individual domains can be represented as D1: 12-218; D2: 365-576; D': 754-805; D3: 844-1052; A1: 1255-1431; A2: 1476-1643; A3: 1669-1849; D4: 1927-2131; B: 2233-2306 (named C1 in EXPASY); C1: 2407-2473 (named C2 in EXPASY); C2: 2558-2623 (named C3 in EXPASY); and CK: 2701-2790.

The vWF D'D3 domain comprised in a chimeric protein according to the present invention is fused with FVIII to inhibit a recombinant FVIII according to the present invention from binding to endogenous vWF (full-length vWF).

The vWF D'D3 domain comprised in the chimeric protein according to the present invention may be of various lengths or origins so long as it retains such activity, and includes mutants, derivatives, variants, complexes or analogues thereof.

In one embodiment, the vWF D'D3 domain comprised in the chimeric protein according to the present invention is composed of the amino acids 742-1248 or has at least 60%, 70%, 80%, 85%, 90%, 95% %, 96%, 97%, 98%, 99% or 100% homology thereto, and prevents the binding of endogenous vWF to the recombinant FVIII according to the present invention.

As mentioned above, the chimeric protein according to the present invention can be embodied as a single polypeptide expressing a light chain and a heavy chain of FVIII as one polypeptide, or double polypeptides expressing each of the light chain and heavy chain as a separate polypeptide.

With regard to FIG. 2A, when the chimeric protein according to the present invention is embodied as a single chain or a single polypeptide, the vWF D'D3 domain may be located in the N- or C-terminal direction of FVIII and may be linked by an amino acid linker that includes an enzyme cleavage site for the separation of D'D3 in the body.

In one embodiment, the FVIII and D'D3 domains comprised in the chimeric protein according to the present invention may be linked by a linker represented by the amino acid sequence of $[G_4S]_n$ (G is glycine, S is serine, and n is an integer between 1 and 100), and the linker includes an enzyme cleavage site. The linker connects D'D3 and FVIII and has the function of providing flexibility for D'D3 to precisely bind to the vWF binding site of FVIII. Specifically, the position at which D'D3 can be fused to FVIII is the N-terminal or C-terminal of the FVIII heavy chain, or the N-terminal or C-terminal of the FVIII light chain. Considering that the D'domain, corresponding to the N-terminal of D'D3 domain, binds to the A3 domain portion of FVIII, and the D3 domain binds to the C2 domain portion of FVIII, it was determined that the distance between the D' domain and the A3 domain of FVIII is the greatest when D'D3 is fused to the C-terminal of the FVIII light chain. Thus, when D'D3 is fused to FVIII, a flexible linker was chosen to allow D'D3 to bind to FVIII properly. Based on the previously reported crystal structure of FVIII, the linear distance from the C-terminal of the C2 domain to the N-terminal of the A3 domain was measured, and the length of the linker was selected by converting the distance to the number of amino acids. Therefore, if the length of the linker is shorter than the above linear distance, the D' domain cannot reach the A3 domain of FVIII, and thus, if the length of the linker is too short, D'D3 cannot bind to the FVIII binding site precisely. Thus, a linker having a sufficient length satisfying the above conditions is required. The optimum length of the linker can vary depending on the location where D'D3 is fused. Linkers of various lengths may be used so long as they have the above function. In one embodiment, n is at least 64. In another embodiment, n may be 4, 6, 8, 10, 16, 21, 22, or 58 in the formula.

In addition, since the linker contains an enzyme cleavage site, the linker also has the function of cleaving out vWF D'D3, or vWF D'D3 and the linker from FVIII when the FVIII is activated.

The enzyme cleavage site included in the linker according to the present invention may be linked in the N- or C-terminal direction of the linker.

In one embodiment according to the present invention, the enzyme cleavage site is a site that can be cleaved by thrombin, which can be represented by DFLAEGGGVR (SEQ ID NO: 36), TTKIKPR (SEQ ID NO: 37), or LVPRGS (SEQ ID NO: 38). In this case, the chimeric protein according to the present invention is cleaved in the body by thrombin to be activated as FVIIIa, and activates Factor X with activated Factor IX (FIXa) to convert it to activated Factor X (FXa).

Also, the enzyme cleavage site which can be included in the linker of the present invention may include a site that can be cleaved by FVIIa, FXa, or FXIa in the coagulant cascade as well as thrombin, which can be represented by ASKPQGRIVGG (SEQ ID NO: 39), IDGR (SEQ ID NO: 40), IEGR (SEQ ID NO: 41), or SKLTRAETVF (SEQ ID NO: 42).

In one embodiment according to the present invention, the enzyme cleavage site is included in the N-terminal direction of a linker, and when this site is cleaved by an enzyme such as thrombin, the linker and the D'D3 domain are separated from the FVIII.

In another embodiment according to the present invention, the enzyme cleavage site is included in the C-terminal direction of the linker, and when this site is cleaved by thrombin, the linker and D'D3 domain are separated from FVIII.

Referring to FIG. 2B, as described above, the chimeric protein according to the present invention is embodied in the form of a two chain in which each of the heavy chain and light chain is expressed as a separate polypeptide, or the heavy and light chains are expressed as two polypeptides of first and second polypeptides. Herein, the light chain and heavy chain can be coupled by a metal ion-mediated non-covalent bond.

When the chimeric protein according to the present invention is embodied as a two chain, the first polypeptide comprises A1, A2 domains and all or a portion of the B domain of the heavy chain of FVIII, and the second polypeptide comprises A3, C1, C2 domains and/or a portion of the B domain of the light chain of FVIII.

When the protein according to the present invention is embodied as a two chain, reference can be made to the foregoing and following descriptions regarding the B domain comprised in the first polypeptide.

When the protein according to the present invention is embodied as a two chain, the second polypeptide may not contain the B domain or a portion of the B domain may be used. In the latter case, for example, it includes 86 residues in the N-terminal direction from the C-terminal residue of the B domain. A portion of the B domain expressed by the second polypeptide is cleaved off when secreted outside the cell.

When the chimeric protein according to the present invention is embodied as a two chain, the vWF D'D3 domain is linked in the C-terminal direction of the first polypeptide. Herein, the B domain can act as a type of linker. When the protein according to the present invention embodied as a two chain, the B domain having the same or longer length can be used as compared to the case in which the protein is expressed in a single chain.

In one embodiment according to the present invention, the B domain of residues 741-902 and 1654-1689 is used based on the sequence of SEQ ID NO: 01 for a single chain, and the B domain of residues 741-936, which is 196 residues long, based on SEQ ID NO: 01 is used for a two chain. When expressed in the form of a two chain, the D' domain may be linked to the B domain, which is for the purpose of structurally more natural linkage between the proteins to be fused, though not limited to this theory. Specifically, in one embodiment, the amino acid residue sequence of the C-terminal of the 196-residue-long B-domain used in the present invention is —SGGPLSLS (SEQ ID NO: 82). The amino acid sequence of the N-terminal of the D' domain begins with SLSCRPPMVKLVCPA- (SEQ ID NO: 83). Thus, the 196-residue-long B domain was used to overlap the three amino acid residues of SLS as shown above. The 196-residue-long B-domain was calculated including up to SGGPL residues only among -SGGPLSLS (SEQ ID NO: 82).

A chimeric protein according to the present invention may comprise one or more vWF D'D3.

D'D3 is the two domains located at the N-terminal of vWF, and the D3 domain actually forms a dimer with vWF of another molecule through the D3 domain. Thus, D'D3 may be fused to FVIII in a monomeric or dimeric form in the present invention.

When a plurality of vWF D'D3, for example, two vWF D'D3 are comprised, they can be embodied as a first D'D3 linked to FVIII and a second D'D3 linked to the first D'D3.

When a plurality of vWF D'D3 are comprised, the first and second D'D3 may be linked through a linker, or the second D'D3 may be separately expressed to form a complex with a chimeric protein. For example, when the first and second D'D3 are linked using a linker as in scFVIII/D'D3/D'D3-120 chimeric protein, reference can be made to the foregoing description regarding the linker, but it does not include an enzyme cleavage site.

Also, when D'D3 is used in the form of a dimer, D'D3 can form a dimer through a S—S bond in the D3 domain. When a plurality of D'D3 are expressed in separate vectors as in a two chain, for example, the DNA of FVIII-D'D3 and the DNA of D'D3 may be expressed simultaneously in one cell to form a dimer between the D'D3s, and secreted outside of the cell, which may be then used after isolation and purification.

Further, the chimeric protein according to the present invention may further comprise one or more Fc proteins. If Fc is further fused to FVIII with D'D3, the effect of increasing the half-life through FcRn recycling by FVIII can be expected in addition to the effect of inhibiting the binding of vWF in the blood by D'D3. In one embodiment, specifically, Fc of about 50 kDa is fused, and steric hindrance by Fc may make it more difficult for the vWF in the blood to bind to the substance.

Therefore, Fc of various lengths or origins can be comprised so long as it achieves the object according to the present invention. In one embodiment according to the present invention, Fc represented by SEQ ID NO: 22 or Fc derived from human IgG are used.

When the chimeric protein according to the present invention is embodied as a single chain, Fc can be linked to vWF D'D3. Herein, they can be linked using a linker, and reference can be made to the foregoing description regarding the linker, but it does not include an enzyme cleavage site.

When the chimeric protein according to the present invention is embodied as a two chain, Fc may be linked to vWF D'D3 expressed as a portion of the heavy chain and/or to the C-terminal direction of the light chain. Herein, they may be linked using a linker. Reference can be made to the foregoing description regarding the linker. Specifically, when it is linked to a light chain, it includes an enzyme cleavage site, but when it is linked to D'D3, it does not include an enzyme cleavage site.

Two or more Fcs may be included in a chimeric protein according to the present invention.

When a plurality of Fcs, for example, two Fcs are comprised, they can be embodied as a first Fc linked to the chimeric FVIII and a second Fc linked to the first Fc in one embodiment. In another embodiment, the first Fc may be linked to the heavy chain of chimeric FVIII expressed as a two chain, and the second Fc may be linked to the light chain (or vice versa), in which case a complex such as a dimer can be formed between the plurality of Fcs.

When a plurality of Fcs are comprised, the first and second Fcs may be linked through a linker, or the second Fc region may be expressed in a separate vector in one cell to form a dimer between the Fcs in the cell, which may be then used after isolation and purification.

As described above, the chimeric protein according to the present invention may be embodied as a single chain or a two chain.

In one embodiment, the chimeric protein in a single chain according to the present invention may be represented by SEQ ID NOs: 6, 7, 8, 9, 10, 11, 12, 13, 14, 15, 16, 17, 18, 19, 21, or 25. The protein may form a complex with separate D'D3 and/or Fc, and in one embodiment, the chimeric protein of SEQ ID NO: 19 may form a complex with at least one D'D3 of SEQ ID NO: 20, or the chimeric protein of SEQ ID NO: 21 may form a complex with at least one Fc represented by SEQ ID NO: 22.

In one embodiment, the chimeric protein in a two chain according to the present invention can be represented by SEQ ID NOs: 4 and 5 (heavy chain and light chain, respectively), SEQ ID NOs: 23 and 24 (heavy chain and light chain, respectively), SEQ ID NOs: 26 and 27 (heavy chain and light chain, respectively), SEQ ID NOs: 28 and 29 (heavy chain and light chain, respectively), SEQ ID NOs: 30 and 31 (heavy chain and light chain, respectively), SEQ ID NOs: 32, and 33 (heavy chain and light chain, respectively), or SEQ ID NO: 34 and 35 (heavy chain and light chain, respectively). The protein may form a complex with separate D'D3 and/or Fc, and in one embodiment, a chimeric protein of SEQ ID NOs: 28 and 29 (heavy chain and light chain, respectively) or SEQ ID NOs: 32 and 33 (heavy chain and light chain, respectively) may form a complex with at least one Fc represented by SEQ ID NO: 22.

The amino acid sequences represented by SEQ ID NOs: 04 to 35 described above also include a protein having 90% or more homology thererto or substantially the same sequence.

Such substantial identity or homology can be determined using sequence comparison methods known in the art. The substantially identical sequences refer to those showing preferably at least 80% homology, specifically 85% or more, more specifically 90% or more homology, even more specifically 95% or more homology when the sequence disclosed herein and any other sequence are aligned for maximum correspondence between them and the aligned sequences are analyzed using algorithms commonly used in the art. Alignment methods for sequence comparison are well known in the art. For example, they are disclosed in: Smith and Waterman, *Adv. Appl. Math.* (1981) 2:482; Needleman and Wunsch, *J. Mol. Bio.* (1970) 48:443; Pearson and Lipman, *Methods in Mol. Biol.* (1988) 24: 307-31; Higgins and Sharp, *Gene* (1988) 73:237-44; Higgins and Sharp, *CABIOS* (1989) 5:151-3; Corpet et al., *Nuc. Acids Res.* (1988) 16:10881-90; Huang et al., *Comp. Appl. BioSci.* (1992) 8:155-65 and Pearson et al., *Meth. Mol. Biol.* (1994) 24:307-31. The NCBI Basic Local Alignment Search Tool (BLAST) (Altschul et al., *J. Mol. Biol.* 215: 403-10(1990)) is available from the National Center for Biological Information (NBCI, Bethesda, Md.), etc., for use in connection with the sequence analysis programs such as blastp, blasm, blastx, tblastn and tblastx. A sequence homology comparison method using this is available at www.ncbi.nlm.nih.gov/BLAST/blast help.

The chimeric protein according to the present invention has a half-life which is extended by at least 1.5-fold, at least 2-fold, and at least 3-fold as compared to wild-type FVIII. Methods for measuring the half-life are disclosed, and a person skilled in the art will be able to select the appropriate method to measure the half-life and activity in consideration of the description of the present invention, the technology and the description of the references in the art, and then determine a chimeric protein to be included in the scope of the present invention based on the measurement results.

In another embodiment, the present invention also relates to a nucleic acid molecule or polynucleotide encoding a chimeric protein disclosed in the present invention, to a vector comprising the polynucleotide, or to a cell (line) transformed with the vector.

The nucleic acid molecule according to the present invention includes one that has been codon-optimized for the type of cells in which the chimeric protein according to the present invention is expressed. In one embodiment according to the present invention, the nucleic acid sequence is optimized for the CHO codon, and such nucleic acid sequence may be represented by the sequence of SEQ ID NO: 58, 59, 60, 62, 63, 64, 65, or 66.

A nucleic acid molecule encoding a chimeric protein according to the present invention also includes one which encodes FVIII which is substantially identical and biologically equivalent, as described above.

Also, the nucleic acid molecules encoding the chimeric protein according to the present invention may also be used by cloning them into various expression vectors for various purposes. The specific composition of the expression vector may vary depending on the host cell in which the chimeric protein according to the present invention is to be expressed. However, it comprises the sequence which regulates the expression of the nucleic acid molecule of the present invention to mRNA or the expression of the mRNA to a protein, such as, for example, a promoter and/or an enhancer, and the like. Various vectors and regulatory sequences which may be used for the above or various other purposes are known in the art and may be selected appropriately by a person skilled in the art in light of the specific objects and effects of the present invention, and such vectors and sequences may include, for example, those disclosed in the Examples and Figures of the present invention, but are not limited thereto.

A vector comprising a nucleic acid molecule encoding a chimeric protein according to the present invention may be prepared by methods known in the art, for example, by operatively linking a nucleic acid molecule encoding a chimeric protein according to the present invention to a promoter and/or an enhancer. In one embodiment, it is inserted into a recombinant expression vector which is capable of expressing a foreign gene in a cell, and examples of such vectors include, but are not limited to, general protein expression vectors such as pMSGneo and pcDNA3.1 (+). The pMSGneo vector is an expression vector containing a MAR (Matrix attachment region) element that binds to a nuclear matrix, and the MAR element plays the role of enhancing gene expression by inducing position-independent expression when used in an expression vector. Therefore, when the pMSGneo vector is used, a stable and high expression level can be achieved. In addition, the pcDNA3.1 (+) vector contains a strong CMV promoter and thus it is widely used for protein expression. In one embodiment of the present invention, the vector shown in FIG. 3 is used. The chimeric protein according to the present invention can be expressed as a single polypeptide or two polypeptides as described above.

In addition, the recombinant expression vector comprising a nucleic acid molecule encoding a chimeric protein according to the present invention may be transfected into a suitable host cell for various purposes. The host cell includes both prokaryotic and eukaryotic cells in which the vector according to the present invention can be amplified and/or the nucleic acid molecule contained in the vector can be expressed. Various cells which can be used for the above purpose are known in the art, and a person skilled in the art will be able to select appropriate cells taking into consideration the specific purposes and effects of the present invention, including those described in the Examples and Figures of the present invention, but is not limited thereto. For example, *E. coli*, mammalian cells, yeasts, plant cells, and insect cells can be included. In one embodiment according to the present invention, eukaryotic cells, in particular, mammalian cell lines, are used for the expression of recombinant FVIII. A person skilled in the art, taking into consideration the characteristics of the recombinant FVIII according to the present invention, will be able to select appropriate cell lines capable of expressing proteins having such characteristics, and for example, CHO, BHK, COST HEK cell lines, etc., which are known in the art may be used as such mammalian cell lines, preferably, CHO cell line, specifically CHO-S cell line or CHO-K1 cell line or CHO-DG44 cell line, or HEK cell line, specifically HEK293 cell line, may be used, but the present invention is not limited thereto.

The vector according to the present invention is transferred to the above host cells for expression. Methods for transferring vectors to such host cells are known in the art, which may be implemented by known methods in the art, such as calcium phosphate precipitation, a shotgun method, a method using liposome, a nanoneedle method or electroporation, but are not limited thereto.

In another aspect, the present invention also relates to a method for producing a chimeric protein comprising transfecting a vector according to the present invention described above to a eukaryotic cell; culturing the cell in a culture solution; collecting the culture solution to purify a cysteine-introduced chimeric protein; and treating the purified cysteine-introduced protein with a PEGylation buffer solution; restoring the free thiol group of the introduced cysteine through a reduction process; oxidizing the resultant to recover a separated disulfide bond in the chimeric protein during the reduction process; specifically PEGylating the cysteine on the chimeric protein restored with a reduced thiol group, and isolating the PEGylated chimeric protein.

Reference can be made to those described in the Examples herein regarding specific vectors, cells and processing steps used in the method according to the present invention.

The chimeric protein according to the present invention can be useful for blood coagulation of a patient with a disease requiring blood coagulation, hemophilia, specifically, hemophilia A, or for the treatment of hemophilia A.

In another embodiment, the present invention also provides a method for treating hemophilia, specifically, hemophilia A, or for blood coagulation, comprising administering, in a therapeutically effective amount, a chimeric protein according to the present invention, a nucleic acid molecule encoding the same, a vector comprising the nucleic acid molecule, or a cell comprising the nucleic acid molecule or vector, or a pharmaceutical composition containing a pharmaceutical acceptable carrier in addition to the above ingredients, as described above, to a patient with a disease requiring blood coagulation, or hemophilia, specifically, hemophilia A.

The chimeric protein according to the present invention, a nucleic acid molecule encoding the same, a vector comprising the nucleic acid molecule can be provided in a form of a pharmaceutical composition containing a pharmaceutical acceptable carrier in addition to the above ingredients for treating hemophilia, specifically, hemophilia A.

In addition, the pharmaceutical composition of the present invention can be used alone or in combination with other drug therapies and methods using a biological response modifier.

In addition to the above-mentioned active ingredients, the composition of the present invention may by prepared by further comprising at least one pharmaceutically or physiologically acceptable carrier.

The term "carrier" as used herein is intended to mean a pharmaceutically acceptable carrier, excipient, or stabilizer that is non-toxic to a cell or mammal exposed to the same at a dose and concentration employed. Examples of such carriers include saline, Ringer's solution, buffered saline, buffers such as phosphate, citrates and other organic acids, antioxidant such as ascorbic acids, polypeptides with low molecular weight (about less than 10 amino acids), proteins such as serum albumin, gelatin or immunoglobulin; hydrophilic polymer such as polyvinylpyrrolidone, amino acids such as glycine, glutamine, asparagine, arginine or lysine, carbohydrates such as monosaccharides, disaccharides, and glucose, mannose or dextrin, chelating agents such as EDTA, sugar alcohols such as mannitol or sorbitol, counter ions for salt formation such as sodium, and/or non-ionic surfactant such as Tween, polyethylene glycol (PEG) and PLURONICS®.

If desired, the composition may further comprise other additives known in the art such as antioxidants, buffers, antibacterial agents. The present composition may be formulated into injectable formulations such as solution, suspension, emulsion, etc., by adding diluents, dispersing agents, surfactants, binders and lubricants. Further, the composition can be preferably formulated depending on the disease or ingredients, using appropriate methods in the art or as disclosed in Remington's Pharmaceutical Science (recent edition; Mack Publishing Company, Easton Pa.).

The composition of the present invention is preferably administered parenterally (for example, intravenous, subcutaneous, intraperitoneal) according to a desired method. The dosage varies depending on the disease condition and weight of a patient, degree of the disease, the type of a drug, the administration route and time, but can be appropriately selected by a person skilled in the art.

The composition according to the present invention is administered in a therapeutically effective amount. In the present invention, "a therapeutically effective amount" refers to an amount sufficient to treat a disease with a reasonable benefit/risk ratio which is applicable to a medicinal treatment. The level of effective dose may be determined depending on factors including types of diseases of patients, severity, activity of a drug, sensitivity to a drug, administration time, administration routes, excretion rates, period of treatment, a simultaneously used drug, and other factors well known in the medicinal field. The composition of the present invention may be administered as a single therapeutic agent or administered in combination with other therapeutic agents. Also, the composition of the present invention may be administered with a conventional therapeutic agent sequentially or simultaneously, and the composition may be used for single or multiple administrations. It is important to administer the composition at a minimal dose which can lead to a maximum effect without side effects in consideration of all of the factors described above, and the doses may be easily determined by a person skilled in the art.

As used herein, the term "treatment" refers to any action that improves or alters the symptoms of a disease in a beneficial way by administration of a composition of the present invention. The subjects for whom the method according to the present invention is used may be primates, including humans, but are not limited thereto.

The recombinant chimeric protein according to the present invention may be administered as it is or in form of a composition as described above in a therapeutically effective amount to a subject with hemophilia or in need of blood coagulation and may be provided in the form of a blood coagulation method or a method for treating hemophilia, and reference can be made to the foregoing description.

Hereinafter, the present invention is explained in detail by Examples. The following Examples are intended to further illustrate the present invention without limiting its scope.

MODE FOR THE INVENTION

Example

Example 1. Construction of Chimeric FVIII

Example 1-1. Preparation of scFVIII (Single-Chain FVIII)

For the construction of FVIII expressed in a single chain form, FVIII was constructed in which a portion of the B domain including the furin cleavage site, the residue 1648 (based on the amino acid sequence of SEQ ID NO: 01 which represents the full-length FVIII amino acid sequence), was deleted. Each constructed scFVIII comprises a B domain of a specific length counting from the N-terminal (the 741st amino acid residue of SEQ ID NO: 01) of the B domain, and the B domain comprised was constructed so as to contain the originally existing sugar chain as it is, and the 782 nd isoleucin residue located in the B domain was modified by cysteine for site-specific PEGylation.

The preparation method is as follows.

Each scFVIII comprising the B domain having deletions shown in Table 1 was synthesized based on the human FVIII nucleic acid sequence (NM000132). In order to prepare the scFVIII gene expression vector, entire gene of the CSL form (leader-heavy chain-B domain (741-764, 1653-1689)-light chain) was synthesized by GeneArt based on the human FVIII nucleic acid sequence (NM000132) to include the PacI-XhoI enzyme cleavage site at the 5' end and PacI-XhoI enzyme cleavage site at the 3' end. The pcDSW-CSL expression vector was constructed by cloning the synthesized gene into the NotI/XhoI site of the pcDSW vector. The accuracy of the expression vector construction was confirmed by size comparison of the cleaved bands using the AsisI/PacI enzyme. Then, each scFVIII in which B domain was deleted was synthesized by GeneArt to include a sequence from the BamHI site (GGATCC) present in the A2 domain of the FVIII heavy chain to the PacI enzyme cleavage site at the 3' end of the light chain. Then, the pre-existing FVIII region was removed from the previously prepared pcDSW-CSL expression vector using the enzyme BamHI/PacI, and the synthesized gene was cleaved with BamHI/PacI enzyme and cloned into the BamHI/PacI site of the pcDSW-CSL expression vector to construct the pcDSW-scFVIII expression vector. The accuracy of the expression vector construction was confirmed by size comparison after cleavage with BamHI/PacI enzyme.

TABLE 1

| scFVIII constructed in the present invention | | | | |
|---|---|---|---|---|
| Single chain FVIII | Heavy chain sequence | A portion of B domain sequence (including a3 domain sequence) | Light chain sequence | Number of B domain |
| G4 Scf4 | 1-740 | (741-902) - - - (1654-1689) | 1690-2332 | 4(757, 784, 828, 900) |

As for scFVIII G4 (B3, SEQ ID NO: 3) in which cysteine is introduced, the gene was synthesized by GeneArt to include a sequence from BamHI site (GGATCC) in the cysteine substitution site and FVIII heavy chain A2 domain to the PacI enzyme cleavage site at the 3' end of the light chain. Then, the pre-existing FVIII region was removed from the previously prepared expression vector pcDSWscFVIII G4 using the enzyme BamHI/PacI, and the synthesized gene was cloned into the BamHI/PacI site to construct pcDSW-scFVIII G4 (B3) expression vector in which cysteine was substituted, and the accuracy of expression vector construction was confirmed by sequence analysis.

Examples 1-2. Preparation of dcFVIII (Two Chain FVIII)

For the construction of FVIII expressed in a dimeric form containing D'D3, the heavy chain containing D'D3 and light chain were expressed using different vectors in one cell. The heavy chain containing D'D3 contains the B domain corresponding to B3 used in Example 1-1, and the light chain was produced with reference to the vector expressing the light chain described in Korean Patent No. 251286.

Examples 1-3. Preparation of Chimeric FVIII

The chimeric FVIII was fused with one or two D'D3 based on the single chain FVIII and dimer FVIII prepared in Examples 1-1 and 1-2, and a linker was used for the effective binding of the fused D'D3 to FVIII. For the linker, a portion of the B domain of FVIII or [$G_4S$ (SEQ ID NO: 81)]$_n$ was used. And, some chimeric FIII contained Fc in addition to the composition described above (FIGS. 2 and 3, and Table 2).

TABLE 2

Chimeric FVIII constructed in the present invention

| Name | Amino acid Sequence number | Nucleic acid Sequence number | FVIII form | D'D3 form | Presence or absence of Fc | Type of linker | Number of amino acids of linker |
|---|---|---|---|---|---|---|---|
| dcFVIII/D'D3-HC | 04 and 05: Heavy chain and light chain, respectively | 46, 47 | Two chain | Monomer | Absent | B domain | 196 |
| scFVIII/D'D3-6 | 06 | 48 | Single chain | Monomer | Absent | $G_4S$ (SEQ ID NO: 81) | 6 |
| scFVIII/D'D3-10 | 07 | 49 | Single chain | Monomer | Absent | $G_4S$ (SEQ ID NO: 81) | 10 |
| scFVIII/D'D3-20 | 08 | 50 | Single chain | Monomer | Absent | $G_4S$ (SEQ ID NO: 81) | 20 |
| scFVIII/D'D3-30 | 09 | 51 | Single chain | Monomer | Absent | $G_4S$ (SEQ ID NO: 81) | 30 |
| scFVIII/D'D3-40 | 10 | 52 | Single chain | Monomer | Absent | $G_4S$ (SEQ ID NO: 81) | 40 |
| scFVIII/D'D3-50 | 11 | 53 | Single chain | Monomer | Absent | $G_4S$ (SEQ ID NO: 81) | 50 |
| scFVIII/D'D3-60 | 12 | 54 | Single chain | Monomer | Absent | $G_4S$ (SEQ ID NO: 81) | 60 |
| scFVIII/D'D3-90 | 13 | 55 | Single chain | Monomer | Absent | $G_4S$ (SEQ ID NO: 81) | 90 |
| scFVIII/D'D3-120 | 14 | 56 | Single chain | Monomer | Absent | $G_4S$ (SEQ ID NO: 81) | 120 |
| scFVIII/D'D3-120-TH1 | 15 | 57, 58, 59 or 60 (codon-optimized) | Single chain | Monomer | Absent | $G_4S$ (SEQ ID NO: 81) | 120 |
| scFVIII/D'D3-120-TH2 | 16 | 61 | Single chain | Monomer | Absent | $G_4S$ (SEQ ID NO: 81) | 120 |
| scFVIII/D'D3-300 | 17 | 62 | Single chain | Monomer | Absent | $G_4S$ (SEQ ID NO: 81) | 300 |
| scFVIII/D'D3/D'D3-120 | 18 | 63 | Single chain | Dimer | Absent | $G_4S$ (SEQ ID NO: 81) | 120 |
| | | | | | | $G_4S$ (SEQ ID NO: 81) | 30 |
| Complex of D'D3/scFVIII-120 and D'D3 | 19 and 20: Single chain FVIII and D'D3, respectively | 64 and 65 Single chain FVIII and D'D3, respectively | Single chain | Dimer | Absent | $G_4S$ (SEQ ID NO: 81) | 120 |

TABLE 2-continued Chimeric FVIII constructed in the present invention

| Name | Amino acid Sequence number | Nucleic acid Sequence number | FVIII form | D'D3 form | Presence or absence of Fc | Type of linker | Number of amino acids of linker |
|---|---|---|---|---|---|---|---|
| Complex of scFVIII/D'D3/Fc-120 and Fc | 21 and 22: Single chain FVIII and Fc, respectively | 66 and 67: Single chain FVIII and Fc, respectively | Single chain | Monomer | Present | G₄S (SEQ ID NO: 81) G₄S (SEQ ID NO: 81) | 120 30 |
| dcFVIII/D'D3/D'D3 | 23 and 24 Heavy chain and light chain, respectively | 68 and 69 Heavy chain and light chain, respectively | Two chain | Dimer | Absent | B domain G₄S (SEQ ID NO: 81) | 196 30 |
| scFVIII/D'D3/Fc/Fc-120 | 25 | 70 | Single chain | Monomer | Present | G₄S (SEQ ID NO: 81) G₄S (SEQ ID NO: 81) G₄S (SEQ ID NO: 81) | 120 30 30 |
| dcFVIII/D'D3/Fc-HC/Fc-LC | 26, and 27 Heavy chain and light chain, respectively | 71 and 72 Heavy chain and light chain, respectively | Two chain | Monomer | Present | B domain G₄S (SEQ ID NO: 81) G₄S (SEQ ID NO: 81) | 196 30 30 |
| Complex of dcFVIII/D'D3/Fc-HC/HC/LC and Fc | 28, 29, and 22 Heavy chain, light chain and Fc, respectively | 73, 74, and 67 Heavy chain, light chain and Fc, respectively | Two chain | Monomer | Present | B domain G₄S (SEQ ID NO: 81) | 196 30 |
| dcFVIII/D'D3/Fc/Fc-HC | 30 and 31 Heavy chain and light chain, respectively | 75 and 76 Heavy chain and light chain, respectively | Two chain | Monomer | Present | B domain G₄S (SEQ ID NO: 81) G₄S (SEQ ID NO: 81) | 196 30 30 |
| Complex of dcFVIII/D'D3-HC/Fc-LC/HC/LC and Fc | 32, 33, and 22 Heavy chain, light chain and Fc, respectively | 77, 78, and 67 Heavy chain, light chain and Fc, respectively | Two chain | Monomer | Present | B domain G₄S (SEQ ID NO: 81) | 196 30 |
| dcFVIII/D'D3-HC/Fc/Fc-LC/HC/LC | 34 and 35 Heavy chain and light chain, respectively | 79 and 80 Heavy chain and light chain, respectively | Two chain | Monomer | Present | B domain G₄S (SEQ ID NO: 81) G₄S (SEQ ID NO: 81) | 196 30 30 |

Cloning of chimeric FVIII was carried out using scFVIII G4 (B3) described in Patent Example 1-1. As for the FVIII heavy chain of SEQ ID NO: 04, the gene was synthesized by GeneArt to include a sequence from the KpnI enzyme cleavage site present in the A2 domain of FVIII to the PacI enzyme cleavage site at the 3' end. Then, pre-existing FVIII region was removed from the scFVIII G4 (B3) expression vector pcDSW-scFVIII G4 (B3) using the enzyme KpnI/PacI, and the synthesized gene was cloned into the KpnI/PacI site to construct an expression vector corresponding to the heavy chain of SEQ ID NO: 4, and the accuracy of expression vector construction was confirmed by length analysis through enzyme cleavage. As for the light chain of SEQ ID NO: 05, the gene was synthesized by GeneArt to include a sequence from the Asis-Leader sequence at the 5' end to the BspEI enzyme cleavage site present at the FVIII light chain C1 domain. Then, the pre-existing FVIII region was removed from the scFVIII G4 (B3) expression vector pcDSW-scFVIII G4 (B3) prepared in Example 1-1 using the enzyme AsiSI/BspEI and the synthesized gene was cloned into the AsiSI/BspEI site to construct an expression vector corresponding to the light chain of SEQ ID NO: 5, and the accuracy of vector construction was confirmed by length analysis through enzyme cleavage. The genes of SEQ ID NO: 06, 07, 08, 09, 10, 11, 12, 13, 14, 15, and 16 were synthesized by GeneArt to include a sequence from the BspEI enzyme site sequence present at the C1 domain of the FVIII light chain to the PacI enzyme cleavage site at the 3' end. Then the pre-existing FVIII region was removed from the scFVIII G4 (B3) expression vector pcDSW-scFVIII G4 (B3) prepared in Example 1-1 using the enzyme BspEI/PacI, and the synthesized genes were cloned into the BspEI/PacI site to construct chimeric FVIII expression vectors corresponding to SEQ ID NOs: 06, 07, 08, 09, 10, 11, 12, 13, 14, 15, and 16, and the accuracy of expression vector construction was confirmed by length analysis and sequence analysis through enzyme cleavage. As compared to the SEQ ID NO: 14, the peptide represented by SEQ ID NO: 15 differs in the position of the thrombin cleavage site in the linker, and the peptide represented by SEQ ID NO: 16 differs in the position of the thrombin cleavage site and the sequence of the linker itself, and they were designated as TH1 and TH2.

As for the SEQ ID NOs: 17, 18, and 21, CHO codon optimization and gene synthesis were carried out by Cosmogenetech to include a sequence from the BspEI enzyme site in the FVIII light chain C1 domain to the PacI enzyme cleavage site at the 3' end. Then, the pre-existing FVIII region was removed from the scFVIII G4 (B3) expression vector pcDSW-scFVIII G4 (B3) prepared in Example 1-1 using the enzyme BspEI/PacI, and the synthesized genes were cloned into the BamHI/PacI site to construct chimeric FVIII expression vectors corresponding to SEQ ID NO: 17, SEQ ID NO: 18, and SEQ ID NO: 21, and the accuracy of expression vector construction was confirmed by length analysis through enzyme cleavage.

As for the SEQ ID NO: 19, CHO codon optimization and gene synthesis were carried out by Cosmogenetech to include a sequence from the NotI-AsiSI enzyme cleavage site added at the 5' end to the AflII enzyme cleavage site present in the FVIII heavy chain A1 domain. Then, the pre-existing FVIII region was removed from the scFVIII G4 (B3) expression vector pcDSW-scFVIII G4 (B3) prepared in Example 1-1 using the enzyme AsiSI/AflIII, and the synthesized gene was cloned into the BamHI/PacI site to construct the chimeric FVIII expression vector corresponding to SEQ ID NO: 19, and the accuracy of expression vector construction was confirmed by length analysis through enzyme cleavage.

As for SEQ ID NO: 20, the gene represented by SEQ ID NO: 64 synthesized in Cosmogenetech was removed of the pre-existing region gene using the enzyme MfeI/XbaI, and the synthesized gene represented by SEQ ID: 63 was treated with the enzyme MfeI/XbaI to obtain an insert, which was then subjected to primary cloning into the MfeI/XbaI site. To transfer the primary cloned gene to an expression vector, the pre-existing FVIII region was removed from the scFVIII G4 (B3) expression vector pcDSW-scFVIII G4 (B3) prepared before using the enzyme NotI/PacI, and then the primary cloned gene was digested with enzyme NotI/PacI to cleave out the insert, which was cloned into the NotI/PacI site of the expression vector to construct an expression vector corresponding to SEQ ID NO: 20. The accuracy of the expression vector construction was confirmed by length analysis through enzyme cleavage.

As for SEQ ID NO: 22, the gene was synthesized by GeneArt to include AsisI at the 5' end and the PacI enzyme cleavage site at the 3' end. Then, the pre-existing FVIII region was removed from the scFVIII G4 (B3) expression vector pcDSW-scFVIII G4 (B3) prepared in Example 1-1 using the enzyme AsisI/PacI, and the synthesized gene was cloned into the AsisI/PacI site to construct an expression vector corresponding to SEQ ID NO: 22. The accuracy of the expression vector construction was confirmed by length analysis through enzyme cleavage.

In addition, as for SEQ ID NO: 15, a CHO expression vector was further prepared to prepare the CHO transformed cell line. The gene was either synthesized to include AatII-AscI at the 5' end and the BsiWI-PacI enzyme cleavage site at the 3' end, or synthesized to be optimized for the CHO expression by Biobasics Co., GeneArt Co., and Genscript Co. The synthesized gene was cloned into the AscI/PacI site of the CHO expression vector pMSID2 to construct a CHO expression vector corresponding to SEQ ID NO: 15. The accuracy of expression vector construction was confirmed by length analysis through enzyme cleavage.

Example 2. Expression of Chimeric FVIII

The chimeric FVIII constructed in Example 1 was expressed in cells, and the cells showing expression were cultured in a cell culture medium. For the expression, the expression vector constructed in Example 1 was transferred and imported to Expi293™ cells using the Expi293™ Expression System Kit (Thermofisher Co., Catalog Number A14635). Transfection method and culture were carried out as follows based on 30 mL scale, and the actual culture volume was adjusted depending on the amount of protein requirement. 24 hours before transfection, Expi293F™ cells were subcultured according to the expected requirement amount using Expi293 culture medium at $2.0 \times 10^6$ cells/mL. On the day of transfection, the number of cells and cell viability were measured, and transfection was carried out when the cell viability was 95% or higher. Expi293 culture medium was added to a 125 mL flask to obtain an amount of $7.5 \times 10^7$ cells, and adjusted to 25.5 mL. 30 μg of the expression vector constructed in Example 1 was mixed with Opti-MEM to a total volume of 1.5 mL. 80 μL of the transfection reagent was mixed with Opti-MEM to a total volume of 1.5 mL and incubated at room temperature for 5 minutes. 5 minutes later, the Opti-MEM containing the transfection reagent was added to Opti-MEM containing DNA, which was then gently mixed. The reaction was carried out at room temperature for 20 to 30 minutes. 3 mL of DNA: transfection reagent complex was added dropwise to the 125 mL flask Expi293™ cells prepared before (total volume: 28.5 mL) and incubated at 37° C. in a 5% $CO_2$ shaking incubator at 125 rpm. After 16 to 20 hours, 150 μL and 1.5 mL of Enhancer 1 and Enhancer 2, respectively, were added thereto and the cells were cultured at 34° C. in a 5% $CO_2$ shaking incubator at 125 rpm. On the second day of culture, all cells were centrifuged and the pre-existing culture medium was completely removed, and all the cells were dispensed in 30 mL of new culture medium and cultured at 34° C. in a 5% $CO_2$ shaking incubator at 125 rpm. On the third day of introduction, all cells which expressed chimeric FVIII were centrifuged and the culture solution was recovered. The cells remaining after the recovery of the medium were dispensed in a new culture medium of the same volume and cultured at 34° C. for 1 day. This process was repeated until the fifth day of culture, and the culture solution on the 3rd, 4th, and 5th days was recovered, and the activity analysis and purification of chimeric FVIII introduced with cysteine were carried out. FVIII expression was carried out in CHO-DG44 cells by a similar method as above.

In addition, CHO transformation cell line was prepared and chimeric FVIII was expressed. 24 hours before transfection, CHO DG44 cells were subcultured in CDM4CHO medium (Hyclone, Catalog Number, SH30557.02) in an amount of 5-6×10$^5$ cells/mL according to the required amount. On the day of transfection, the cells were dispensed in an amount of 3 mL to the 125 mL flask using OptiPro medium (Thermo fisher, Catalog Number 12309-019) at 1×10$^7$ cells/mL. 30 μg of the CHO expression vector constructed in Example 1 was mixed with OptiPro to a total volume of 1.5 mL. The resultant mixture was mixed using 90 μL PEI MAX (1 μg/μL) and OptiPro to a total volume of 1.5 mL. After 5 minutes, 1.5 mL of OptiPro containing PEI MAX was added to 1.5 mL of OptiPro containing DNA, which was then gently mixed for 30 minutes at room temperature. 3 mL of DNA: PEI complex was added dropwise to CHO DG44 cells prepared before. The cells were incubated at 37° C. in a 5% $CO_2$ shaking incubator at 140 rpm for 4 hours. 24 mL of CDM4CHO medium was added thereto and the cells were incubated at 140 rpm, and cell screening was carried out after 48 hours.

The transformed CHO DG44 cells were suspended into a T-175 flask using CDM4CHO culture medium containing 20 nM MTX at 5×10$^6$ cells/ml to obtain a volume of 50 ml, which were subjected to static culture for 7 days at 37° C. in a 5% $CO_2$ incubator. If the number of cells was insufficient, the total volume was reduced and proceeded. After 7 days of cell screening, the number of cells were counted, and the cells were subcultured in a 125 mL flask at 5×10$^5$ cells/mL using a culture medium containing 20 nM MTX at 37° C. in a 5% $CO_2$ shaking incubator at 140 rpm. The cells were subcultured in a 125 mL flask at the interval of 3 to 4 days, and when the cell concentration was 1×10$^6$ cells/mL or higher and the viability was 90% or higher, it was determined that the screening was completed.

For the expression of chimeric FVIII, the CHO transformation cell line was inoculated at 3×10$^5$ cells/mL and incubated at 37° C. in a 5% $CO_2$ shaking incubator at 140 rpm. On the fourth day of culture, all cells were centrifuged, and the pre-existing culture medium was completely removed, and all cell were dispensed in a new culture medium of the same volume and incubated at 140 rpm for 1 day at 31° C. in a 5% $CO_2$ shaking incubator. The culture medium exchange and culture process was repeated until the 8th day of culture, and culture solution on the 6th, 7th, and 8th day was recovered, and the activity analysis and purification of chimeric FVIII was conducted.

Example 3. Confirmation of Chimeric FVIII Expression

Example 3-1. Measurement of Chimeric FVIII Expression Level

Two of the widely used FVIII activity measurement test methods are the one-stage clotting method and the chromogenic method. Among them, chimeric FVIII expression level was measured by the chromogenic method. Chromogenic method is a method of measuring FVIII activity based on the degree of color development of a chromogenic substance, where FIXa, FX, thrombin, calcium, phospholipids and a FVIII sample are mixed and a chromogenic substrate which shows color development upon cleavage by FXa is added thereto in order to measure the amount of FXa activated by FVIII sample.

As for the experimental method of chromogenic method, the chromogenic assay kit sold by CHROMOGENIX Co., was used as the endpoint method, and the test was conducted by modifying the test method provided by the manufacturer to be suitable for the present test. Samples are diluted to be in the standard range (0.25-1 IU/mL) using 1× dilution buffer. Calibration plasmas were prepared using 1× dilution buffer at the concentrations of 0, 0.25, 0.5, and 1 IU/mL. The prepared samples and 10 μL of the calibration plasma were diluted by 790 μL of 1× dilution buffer, and 50 μL of the diluted samples were dispensed into a 96-well plate and allowed to stand at 37° C. for 5 minutes. 50 μL of a factor reagent was dispensed into each well using an automatic dispenser pipette, which was then reacted for 2 minutes at 37° C. 50 μL of a substrate was dispensed into each well, which was then allowed to stand for 2 minutes at 37° C. for color development. The reaction was stopped by adding 50 μL of 2% citric acid to the samples showing color development. The absorbance was measured at a wavelength of 405 nm to draw a linear calibration curve, and the absorbance of the sample was substituted into the calibration curve to measure the activity of the sample.

TABLE 3

Chimeric FVIII expression level

| Name | Host | Condition | Expression level (IU/mL) |
|---|---|---|---|
| scFVIII-B3 | HEK293 | Transient expression | 1.6-8.0 |
| scFVIII/D'D3-30 | HEK293 | Transient expression | 5.3 |
| scFVIII/D'D3-40 | HEK293 | Transient expression | 1.6 |
| scFVIII/D'D3-50 | HEK293 | Transient expression | 3.7 |
| scFVIII/D'D3-60 | HEK293 | Transient expression | 2.1 |
| scFVIII/D'D3-90 | HEK293 | Transient expression | 6.3 |
| scFVIII/D'D3-120 | HEK293 | Transient expression | 4.7 |
| scFVIII/D'D3-120-TH1 | HEK293 | Transient expression | 2.8 |
| scFVIII/D'D3-120-TH1 | CHO | Stable expression | 0.06-8.3 |
| scFVIII/D'D3-120-TH2 | HEK293 | Transient expression | 3.5 |
| scFVIII/D'D3-300 | HEK293 | Transient expression | 2.5 |
| scFVIII/D'D3/D'D3-120 | HEK293 | Transient expression | 0.3 |
| scFVIII/D'D3/Fc-120, Fc | HEK293 | Transient expression | 1.4 |
| dcFVIII/D'D3-HC | HEK293 | Transient expression | 0.1 |

The measured expression levels of scFVIII-B3, which was not fused with the fusion with D'D3 ranged from 1.6 to 8.0 IU/mL. In the case of chimeric FVIII fused with D'D3, it was found that when it was expressed in a single chain form, the expression level was similar to that of scFVIII-B3 the fusion of D'D3. However, it was found that when expressed as a dimer, the expression level was 0.1 IU/mL, which was 10 times or more lower than that of pre-existing scFVIII-B3, and the measured results are shown in Table 3.

Example 3-2. Expression Pattern Analysis

After the chimeric FVIII constructed in the present invention was purified according to Example 4, the expression pattern of the purified sample was confirmed by Western blot analysis.

The culture solution and LDS sample buffer were mixed at a ratio of 3:1, and 30 μL of the mixed sample was loaded on 4-12% bis-tris (BT) gel and run for about 1 hour at 150 volts. The gel which completed the running was transferred to a nitrocellulose (NC) membrane, and allowed to stand in a blocking buffer (Thermo Scientific) for 1 hour. The primary antibody recognizing the heavy chain (GMA-012, Green Mountain Antibodies), light chain (ab41188, Abcam) and D'D3 (96340, Abcam) of the Factor VIII was prepared by dilution in a TBST buffer, and was reacted for 1 hour with a NC membrane which completed the blocking. The resultant was washed for 3 times at 5 minutes intervals using a TBST buffer. The secondary antibody (Goat anti-mouse IgG-HRP conjugate) was prepared by dilution with a TBST buffer, and was reacted with a NC membrane for 10 minutes. The resultant was washed for 5 times at 5 minutes intervals using a TBST buffer. The ECL Prime Western Blotting Detection Reagent was scattered thereto to color develop the NC membrane, and the membrane was exposed to Hyperfilm ECL (GE healthcare) and developed in a dark room.

As a result, it was confirmed that all of the chimeric FVIIIs expressed in a single chain were expressed in a form designed in the present invention, and the expression pattern did not change depending on the linker length (FIG. 5).

Example 4. Chimeric FVIII Production

The production process of chimeric FVIII largely consists of five steps. Purification was carried out using the culture solution used for the culture in Example 2.

In the first step, the process of separating and purifying chimeric FVIII from the culture medium was conducted using the VIIISelect resin developed by GE Inc. for purification. The VIIISelect resin was packed into a column and the column was washed with 2% citric acid. It was equilibrated by flowing an equilibrium buffer (20 mM Histidine, 5 mM $CaCl_2$), 1 M NaCl, 0.02% Tween® 80, pH 7.0). 5 M NaCl buffer was added to the culture solution to a final concentration of 1 M NaCl, which was then titrated to pH 7.0, and loaded onto the column. After loading the culture solution, it was equilibrated by flowing the equilibrium buffer until the UV fell to the baseline. Chimeric FVIII was eluted by flowing an elution buffer (20 mM Histidine, 5 mMCaCl 2, 0.9 M Arginine, 45% propylene glycol, 0.02% Tween® 80, pH 6.5).

In the second step, a process of removing the propylene glycol mixed in the eluent in the first step and removing some mixed impurities was conducted using Q fast flow resin from GE Inc. After the Q fast flow resin was packed into a column, the column was washed by flowing a washing buffer (0.5 M NaOH, 1 M NaCl). It was equilibrated by flowing an equilibrium buffer (20 mM Histidine, 5 mM $CaCl_2$), 0.02% Tween® 80, pH 7.0). The eluent in the VIIISelect process was diluted 10-fold by an equilibration buffer, titrated to pH 7.0, and loaded onto the column. After the loading, it was equilibrated by flowing an equilibrium buffer until the UV fell to the baseline. Chimeric FVIII was eluted by flowing an elution buffer (20 mM Histidine, 5 mM $CaCl_2$), 500 mM NaCl, 0.02% Tween®80, pH 7.0).

In the third step, a process of conjugating the purified chimera FVIII to PEG was conducted. TCEP was added to the purified chimeric FVIII solution to a final concentration of 0.1 mM, and allowed to stand at 4° C. for 1 hour to reduce the inserted cysteine. Residual TCEP was removed using a PD-10 column (GE healthcare) equilibrated with PEGylated buffer (20 mM Histidine, 5 mM $CaCl_2$), 200 mM NaCl, 0.02% Tween® 80, pH 7.0). It was allowed to stand at 4° C. for 2 hours to oxidize the disulfide bond of the reduced chimera FVIII itself. PEG conjugation was conducted by adding PEG solution (50 mg/mL) dissolved in DMSO at a ratio of PEG to protein of 1:20, which was then allowed to stand at 4° C. for 12-16 hours.

In the fourth step, a process of removing chimera FVIII without PEG and Chimera FVIII with two or more PEGs, which are impurities formed during the PEGylation process, was conducted using Superdex 200 resin of GE Inc. A pre-packed superdex 200 column was equilibrated by flowing an equilibrated buffer (20 mM Histidine, 5 mM $CaCl_2$), 200 mM NaCl, 0.02% Tween® 80, pH 7.0). The PEGylation process sample was loaded onto the column using a sample loop. After loading, an equilibrium buffer was flowed to collect peaks, and analysis by SDS-PAGE was conducted for pooling of appropriate fractions.

In the fifth step, a process of concentrating the PEGylated chimeric FVIII pooled in the fourth step was conducted. For the process, the FVIII was concentrated to a concentration of 25 IU/mL using Amicon 30 kDa manufactured by Millipore Inc.

SDS-PAGE was conducted for the intermediate sample of the process and the final sample to analyze the degrees of purification and PEGylation (FIGS. 4 and 6). In the case of scFVIII/D'D3, it was confirmed that the purification patterns of the samples with different linker lengths were almost similar. it was found that most of the HCP was removed in the VIIISelect process, the first process, and only the scFVIII/D'D3 in the form of a monomer was purified in the Q FF process, the second process. Thereafter, the PEGylation process was carried out and then the samples were purified to confirm that only PEG-scFVIII/D'D3 was purified.

Example 5. Confirmation of Specific Activity of Chimeric FVIII Substance

In order to confirm the specific activity of chimeric FVIII, the chimeric FVIII activity was measured by a chromogenic method, and the amount of chimeric FVIII protein was measured by the BCA method using BSA as a standard. The specific activity was measured by dividing the results of the activity measurement by the amount of protein. The results are shown in Table 4.

TABLE 4

| Specific activity of chimeric FVIII | | | |
|---|---|---|---|
| Samples | scFVIII/ D'D3-60 | scFVIII/ D'D3-90 | scFVIII/ D'D3-120 |
| CS (IU/ml) | 941.6 | 812.7 | 811.2 |
| BCA (µg/ml) | 101.2 | 95.9 | 86.6 |
| Specific activity (IU/mg) | 9304.3 | 8474.5 | 9367.2 |

In the case of scFVIII/D'D3, it was confirmed that the specific activity values were not significantly different even when the linker length was changed, and the specific activity measured in this example was similar to those of other recombinant FVIIIs.

Example 6. Measurement of Binding Affinity of Chimeric FVIII to LRP or vWF

The binding affinity of the chimeric FVIII to LRP or vWF was measured by an ELISA method. The vWF (HCVWF-0191, Haemtech, 200 µg/mL) or LRP (#04-03, Biomac, 260 µg/mL) was coated onto a 96 well plate in an amount of 100 µL per well, and allowed to stand for 2 hours at room temperature. After 2 hours of incubation, the wells were washed with a washing buffer produced by adding 0.1% Tween® 20 to PBS. Blocking was conducted by adding 200

µL of a blocking buffer produced by adding 1% BSA to PBS to each well and then incubating for 1 hour at room temperature. After the incubation for 1 hour, the wells were washed with a washing buffer produced by adding 0.1% Tween® 20 to PBS. FVIII sample was diluted to an appropriate concentration using a blocking buffer, loaded onto the wells in an amount of 100 µL per well, and incubated for 1 hour at room temperature. The wells were washed with a washing buffer produced by adding 0.1% Tween® 20 to PBS. Anti-Factor VIII biotin (SAF8C-APBIO, Affinity Biologicals, 100 µg/mL) was diluted to 1/2000 using a blocking buffer and was loaded onto the wells in an amount of 100 µL per well, and allowed to stand for 1 hour at room temperature. The wells were washed with a washing buffer produced by adding 0.1% Tween® 20 to PBS.

Streptavidin-HRP (S2438, Sigma-Aldrich) was diluted to 1/3000 using a blocking buffer and loaded the wells in an amount of 100 µL per well, and incubated for 45 minutes at room temperature. The wells were washed with a washing buffer produced by adding 0.1% Tween® 20 to PBS. After treating the wells with TMB substrate (52-00-03, KPL) in an amount of 100 µL per well and incubated for 10 minutes. A stop solution (1 N sulfuric acid) was put into the wells in an amount of 100 µL per well to stop the reactions, and the absorbance at 490 nm was measured.

As a result of the experiment, it was confirmed that the binding of chimeric FVIII to LRP or vWF was significantly reduced compared to ADVATE®. In addition, it was confirmed that, when chimeric FVIII was PEGylated, its binding to LRP or vWF was further reduced (FIGS. 7 and 8).

Example 7. Animal PK Test: PEG-scFVIII/D'D3-120

In order to measure the half-life of the PEGylated chimeric FVIII in the body, a PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII (PEG-scFVIII/D'D3-120 was used in this example) were administered intravenously once at a dose of 125 IU/kg. PK blood samples were collected by sampling 200 µl of blood at 0, 0.083, 2, 6, 9, 16, 22, and 30 hours after administration in the Advate® administration group and at 0, 0.083, 2, 6, 16, 30, 40, 48, 64, and 72 hours after administration in the PEG-scFVIII/D'D3-120 administration group Immediately after sampling, the samples were mixed with an anticoagulant (sodium citrate 3.2% buffer) at a volume ratio of 1:9 and centrifuged to separate plasma. The titers of Advate® and PEG-scFVIII/D'D3-120 were measured using the Chromogenic method and pharmacokinetic parameters were calculated using the non-compartmental (NCA) model of WinNonLin software (version 6.4). As the PK assay results (FIG. 9), the measured half-life of Advate® was about 7.86 hours and the half-life of PEG-scFVIII/D'D3-120 was 26.12 hours, which was 3.3 times longer than Advate®. The mean residence time (MRT) of PEG-scFVIII/D'D3-120 was also increased by 3.6-fold as compared to Advate®. In addition, the elimination rate (CL) of PEG-scFVIII/D'D3-120 was decreased by about 2-fold as compared to Advate®, and the area under the curve (AUC) was increased by about 2-fold.

TABLE 5

Pharmacokinetic parameters of PEGylated chimeric FVIII

| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
|---|---|---|---|---|---|
| Advate ® | 7.86 | 9.43 | 18.55 | 6.74 | 63.51 |
| PEG-scFVIII/D'D3-120 | 26.12 | 33.68 | 38.46 | 3.25 | 109.83 |

Since the concentration of FVIII in the blood is kept at 1% or 3% or more in an actual preventive therapy, the time point when the FVIII concentration in the blood drops at or below 1% or 3% can be delayed by using a long half-life sustained FVIII, which leads to a reduction in the frequency of administrations. In the case of the sustained FVIII developed so far, the half-life in the HA mice was increased by 2-fold or lower as compared to the control. This suggests that the half-life of FVIII did not become longer than that of vWF because FVIII circulates in the blood in a state of strong non-covalent bond with vWF as mentioned above. It is contemplated that the half-life of the chimeric FVIII developed in the present invention increased by 2-fold or more as compared, which is a level sustained FVIII developed so far could not achieve, since the chimeric FVIII developed in the present invention inhibits binding with vWF in the blood, and also prevents the clearance of the chimeric FVIII by LRP. This is considered to be a very meaningful result.

Example 8. Animal PK Test: scFVIII/D'D3-120 Conjugated with Various Sizes of PEG Similar to Example 7, a PK test using a Hemophilia A-type mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using the scFVIII/D'D3-120 conjugated with PEG of different sizes. PK blood samples were collected by sampling 200 µl of blood at 0, 0.083, 2, 6, 9, 16, 22 and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-lives of Advate®, 40 kDa PEG-scFVIII/D'D3-120, and 60 kDa PEG-scFVIII/D'D3-120 were about 7.88 hours, about 20.93 hours, and about 28.09 hours, respectively. The pharmacokinetic profiles and pharmacokinetic parameters are shown in FIG. 10 and Table 6.

TABLE 6

| | Pharmacokinetic parameters of PEGylated chimeric FVIII | | | | |
|---|---|---|---|---|---|
| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
| Advate® | 7.88 | 9.68 | 16.16 | 7.76 | 74.86 |
| 40 kDa PEG-scFVIII/D'D3-120 | 20.93 | 28.17 | 35.78 | 3.50 | 98.44 |
| 60 kDa PEG-scFVIII/D'D3-120 | 28.09 | 35.03 | 39.59 | 3.17 | 109.95 |

Example 9. Animal PK Test: PEG-scFVIII/D'D3-60 and Conjugation of PEG to scFVIII/D'D3-120 Fused with Fc A PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using PEG-scFVIII/D'D3-60 and a substance obtained by conjugating PEG to scFVIII/D'D3-120 fused with Fc. The blood samples were collected by sampling 200 µl of blood at 0, 0.083, 2, 6, 9, 16, 22 and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-lives of Advate®, PEG-scFVIII/D'D3-60, and PEG-scFVIII/D'D3/Fc-120, Fc were about 7.08 hours, about 16.53 hours, and about 18.89 hours, respectively. Pharmacokinetic profiles and pharmacokinetic parameters are shown in FIG. 11 and Table 7.

TABLE 7

| | Pharmacokinetic parameters of PEGylated chimeric FVIII | | | | |
|---|---|---|---|---|---|
| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
| Advate® | 7.08 | 9.38 | 15.84 | 7.95 | 74.56 |
| PEG-scFVIII/D'D3-60 | 16.53 | 22.93 | 29.16 | 4.30 | 98.93 |
| PEG-scFVIII/D'D3/Fc-120, Fc | 18.89 | 26.23 | 26.68 | 4.70 | 123.05 |

Example 10. Animal PK Test: PEG-scFVIII/D'D3-300 and Conjugating PEG to scFVIII/D'D3-120 in which FVIII was Fused with D'D3 in a Dimeric Form at the C-Terminal A PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using PEG-scFVIII/D'D3-300 and a substance obtained by conjugating PEG to scFVIII/D'D3-120 in which FVIII was fused with D'D3 in a dimeric form at the c-terminal. PK blood samples were collected by sampling 200 µl of blood at 0, 0.083, 2, 6, 9, 16, 22 and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-lives of Advate®, PEG-scFVIII/D'D3-300, and PEG-scFVIII/D'D3/D'D3-120 were about 9.02 hours, about 15.76 hours, and about 18.00 hours, respectively. Pharmacokinetic profiles and pharmacokinetic parameters are shown in FIG. 12 and Table 8.

TABLE 8

| | Pharmacokinetic parameters of PEGylated chimeric FVIII | | | | |
|---|---|---|---|---|---|
| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
| Advate® | 9.02 | 10.52 | 18.62 | 6.77 | 71.02 |
| PEG-scFVIII/D'D3-300 | 15.76 | 21.84 | 40.10 | 3.12 | 68.22 |
| PEG-scFVIII/D'D3/D'D3-120 | 18.00 | 22.69 | 39.57 | 3.16 | 71.58 |

Example 11. Animal PK Test: PEG-scFVIII/D'D3-60, PEG-scFVIII/D'D3-120, and PEG-scFVIII/D'D3-300

A PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using PEG-scFVIII/D'D3-60, PEG-scFVIII/D'D3-120 and PEG-scFVIII/D'D3-300. The blood samples were collected by sampling 200 µl of blood at 0, 0.083, 2, 6, 9, 16, 22 and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-life of Advate® was about 6.99 hours, and those of PEG-scFVIII/D'D3-60, PEG-scFVIII/D'D3-120 and PEG-scFVIII/D'D3-300 were about 20.07, 24.48, and 17.13 hours, respectively. Pharmacokinetic profiles and pharmacokinetic parameters are shown in FIG. 13 and Table 9.

TABLE 9

Pharmacokinetic parameters of PEGylated chimeric FVIII

| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
|---|---|---|---|---|---|
| Advate ® | 6.99 | 9.03 | 15.38 | 8.21 | 73.36 |
| PEG-scFVIII/D'D3-60 | 20.07 | 28.07 | 33.82 | 3.70 | 103.59 |
| PEG-scFVIII/D'D3-120 | 24.48 | 29.00 | 33.68 | 3.79 | 105.58 |
| PEG-scFVIII/D'D3-300 | 17.13 | 24.26 | 31.22 | 4.02 | 97.47 |

Example 12. Animal PK Test: PEG-scFVIII/D'D3-120, PEG-scFVIII/D'D3-120-TH1, and PEG-scFVIII/D'D3-120-TH2

A PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using PEG-scFVIII/D'D3-120, PEG-scFVIII/D'D3-120-TH1, and PEG-scFVIII/D'3-120-TH2. The blood samples were collected by sampling 200 µl of blood at 0, 0.083, 2, 6, 9, 16, 22 and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-life of Advate® was about 6.26 hours, and those of PEG-scFVIII/D'D3-120, PEG-scFVIII/D'D3-120-TH1, and PEG-scFVIII/D'3-120-TH2 were about 21.28, 24.19, and 25.28 hours, respectively. Pharmacokinetic profiles and pharmacokinetic parameters are shown in FIG. 14 and Table 10.

TABLE 10

Pharmacokinetic parameters of PEGylated chimeric FVIII

| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
|---|---|---|---|---|---|
| Advate ® | 6.26 | 8.02 | 13.06 | 9.58 | 76.73 |
| PEG-scFVIII/D'D3-120 | 21.28 | 26.50 | 29.22 | 4.29 | 112.48 |
| PEG-scFVIII/D'D3-120-TH1 | 24.19 | 29.42 | 28.92 | 4.33 | 127.26 |
| PEG-scFVIII/D'D3-120-TH2 | 25.28 | 28.94 | 26.90 | 4.65 | 134.13 |

Example 13. Animal PK Test: scFVIII/D'D3-120-TH1 Conjugated with PEG of Various Sizes and Forms A PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using substances obtained by conjugating various PEGs to scFVIII/D'D3-120-TH1. The blood samples were collected by sampling 200 µl of blood at 0, 0.083, 2, 6, 9, 16, 22 and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-life of Advate® was about 7.66 hours, and those of 20 kDa linear PEG-scFVIII/D'D3-120-TH1, 20 kDa branch PEG-scFVIII/D'D3-120-TH1, 40 kDa branch PEG-scFVIII/D'D3-120-TH1 were about 22.98, 16.10, and 27.33 hours, respectively. Pharmacokinetic profiles and pharmacokinetic parameters are shown in FIG. 15 and Table 11.

TABLE 11

Pharmacokinetic parameters of PEGylated chimeric FVIII

| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
|---|---|---|---|---|---|
| Advate ® | 7.66 | 9.85 | 10.93 | 11.77 | 103.63 |
| 20 kDa L PEG-scFVIII/D'D3-120-TH1 | 22.64 | 30.66 | 52.91 | 2.38 | 71.29 |
| 20 kDa B PEG-scFVIII/D'D3-120-TH1 | 15.87 | 24.42 | 48.78 | 2.59 | — |
| 40 kDa B PEG-scFVIII/D'D3-120-TH1 | 28.12 | 38.71 | 60.53 | 2.09 | 77.55 |

Example 14. Thrombin Generation Assay

To examine the thrombin generation profile of PEGylated chimeric FVIII, a thrombin generation assay was conducted. Fluoroskan Ascent™ FL microplate fluorometer and luminometer (5210460, Thermofisher) apparatuses were pre-warmed to 37° C. and the machine line was washed with 37° C. pre-warmed DW. FVIII deficient plasma (0TXW17, Siemens), Calibrator (TS20.00, Thrombinoscope), and PPP-low-reagent (TS31.00, Thrombinoscope) were warmed by leaving them at room temperature for 15 minutes or longer, and then reconstituted by 1 mL of 37° C. pre-warmed DW. 20 µL of the Calibrator or PPP-low-reagent was put into a 96-well plate, which was put into the Fluoroskan apparatus prepared previously to warm it to 37° C. The sample was diluted to an appropriate concentration using the FVIII deficient plasma prepared previously. Fluo-buffer in FluCa-Kit (TS50.00, Thrombinoscope) was prepared by warming to 37° C. 80 µL each of the prepared samples were added to the plate in the Fluoroskan instrument, and 40 µL of a Fluo-substrate was placed in 1 vial of a Fluo-buffer warmed at 37° C. After putting the prepared Flu-Ca in the machine, pre-programmed software was run to dispense Flu-Ca at 20 µL per well, and thrombin generation was proceeded.

The thrombin generation assay showed that the thrombin generation profile was significantly lower in FVIII deficient plasma whereas the thrombin generation profile in chimeric FVIII was gradually increased in a concentration dependent manner. The thrombin generation profile of chimeric FVIII 1 IU/mL was similar to the thrombin generation profile of normal plasma (FIG. 16).

Example 15. Animal Acute Efficacy Test

To examine the efficacy of chimeric FVIII, the acute efficacy test was conducted using the tail clip model of hemophilia A type mice (HA mice). For wild type mice (WT), male C57BL/6 mice weighing 19-25 g provided by Orient Bio were used. For HA mice, male mice weighing 19-25 g provided by Green Cross were selected and used. On the day of the test, after filling saline up to 14 mL in 15 mL conical tubes (1/mouse), the tubes were kept in a heated water bath to maintain the temperature of the saline at 37° C., and the body weights of the mice before administration were measured. Pentobarbital sodium was administered IP at a dose of 60 mg/kg to anesthetize them, and then 0.9% physiological saline, a negative control, or Advate® and PEGylated chimeric FVIII, positive controls, were administered into the jugular vein at a dose of 100 IU/kg in a single dose at a volume of 5 mL/kg. After 5 minutes, HA mice tails were cut at the 4 mm point from the tail end, and the tails were placed in a saline buffer for 30 minutes to collect blood. The blood samples collected for 30 minutes were centrifuged at 1,500 g for 5 minutes to remove the supernatant, and then 10 mL of tertiary distilled water was added to the conical tube using a 10 mL pipet, and the blood was completely hemolyzed using a vortex. To measure blood loss, the hemolyzed samples were analyzed using a hemoglobin assay kit (MAK115-1KT, Sigma-Aldrich).

The concentration of hemoglobin was about 100 nM in wild type mice (WT), and the concentration of hemoglobin was about 1,000 nM in the negative control, HA mice (KO). It was found that Advate® and PEGylated chimeric FVIII showed the hemoglobin concentrations of about 140-450 nM, which are about 55% lower than those of the negative control. It was found that there was no statistically significant difference between Advate® and PEGylated chimeric FVIII (FIG. 17).

Example 16. Animal PK Test: Conjugation of PEGs of Various Sizes and Forms to scFVIII/D'D3-120-TH1 Expressed in CHO Cells PK test using a hemophilia A mouse model (HA mice) was carried out. 8 weeks old mice (20±2 g) were used as the HA mice, and they were subjected to weight measurement before administration, and then grouped (n=3/time point). Then, Advate®, a control, and PEGylated chimeric FVIII were administered intravenously once at a dose of 125 IU/kg. In this example, the PK test was conducted using substances obtained by conjugating various PEGs to scFVIII/D'D3-120-TH1 expressed in CHO cells. The blood samples were collected by sampling 200 μl of blood at 0, 0.083, 2, 6, 9, 16, 22, and 30 hours after administration in the Advate® administration group (control) and at 0, 0.083, 2, 6, 16, 30, 40, 48, 64, 72, and 96 hours after administration in the test group. Immediately after sampling, the samples were mixed with an anticoagulant (sodium citrate 3.2% buffer) at a volume ratio of 1:9 and centrifuged to separate plasma. The titers of Advate® and chimeric FVIII were measured using the Chromogenic method and pharmacokinetic parameters were calculated using the non-compartmental (NCA) model of WinNonLin software (version 6.4).

As the PK assay results, the measured half-life of Advate® was about 8.22 hours, and those of 20 kDa linear PEG-scFVIII/D'D3-120-TH1 and 40 kDa linear PEG-scFVIII/D'3-120-TH1 were about 25.01, and 26.88 hours, respectively. Pharmacokinetic profiles and pharmacokinetic parameters are shown in FIG. 18 and Table 12.

TABLE 12

Pharmacokinetic parameter of PEGylated chimeric FVIII

| PK parameter | $T_{1/2\ terminal}$ (hr) | $MRT_{INF}$ (hr) | $AUC_{INF}$ (hr · IU/ml) | CL (ml/hr/kg) | $V_{SS}$ (ml/kg) |
|---|---|---|---|---|---|
| Advate ® | 8.22 | 10.89 | 13.61 | 9.20 | 103.63 |
| 20 kDa L PEG-scFVIII/D'D3-120-TH1 | 20.12 | 28.22 | 36.73 | 3.40 | 97.98 |
| 40 kDa L PEG-scFVIII/D'D3-120-TH1 | 26.30 | 36.31 | 48.87 | 2.57 | 94.85 |

While the present invention has been described in connection with exemplary embodiments, it is to be understood that the disclosure is not limited to the disclosed embodiments, but is intended to cover various modifications and improvements using the basic concept of the present invention.

All the technical terms that were used in the present invention, have the same meanings that are understood by a skilled person in this art, unless otherwise specified. The contents of all the publications disclosed in the present description as a reference document are incorporated in the present invention.

SEQUENCE LISTING (83 sequences)

SEQ ID NO: 1 - protein, 2332 aa, Homo sapiens
  PEPTIDE (1)..(2332): Full length Factor VIII
  MISC_FEATURE (782): Xaa = Isoleucine or Cysteine
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKXQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 2 - protein, 2791 aa, Homo sapiens
  PEPTIDE (1)..(2791): Full length vWF
AEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 3 - protein, 1581 aa, Artificial Sequence
  Single chain FVIII with partial B domain
  MISC_FEATURE (782): Xaa = Isoleucine or Cysteine
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKXQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 4 - protein, 1443 aa, Artificial Sequence
  dcFVIII/D'D3-HC Heavy chain
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 5 - protein, 772 aa, Artificial Sequence
  dcFVIII/D'D3-HC Light chain
ATDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 6 - protein, 2094 aa, Artificial Sequence
  scFVIII/D'D3-6
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 7 - protein, 2098 aa, Artificial Sequence
  scFVIII/D'D3-10
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 8 - protein, 2108 aa, Artificial Sequence
  scFVIII/D'D3-20
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 9 - protein, 2118 aa, Artificial Sequence
  scFVIII/D'D3-30
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 10 - protein, 2128 aa, Artificial Sequence
  scFVIII/D'D3-40
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 11 - protein, 2138 aa, Artificial Sequence
  scFVIII/D'D3-50
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 12 - protein, 2148 aa, Artificial Sequence
  scFVIII/D'D3-60
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 13 - protein, 2178 aa, Artificial Sequence
  scFVIII/D'D3-90
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 14 - protein, 2208 aa, Artificial Sequence
  scFVIII/D'D3-120
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 15 - protein, 2208 aa, Artificial Sequence
  scFVIII/D'D3-120-TH1
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGGGSLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 16 - protein, 2208 aa, Artificial Sequence
  scFVIII/D'D3-120-TH2
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLSKNNAIEPRGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 17 - protein, 2388 aa, Artificial Sequence
  scFVIII/D'D3-300
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 18 - protein, 2745 aa, Artificial Sequence
  scFVIII/D'D3/D'D3-120
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 19 - protein, 2949 aa, Artificial Sequence
  D'D3/scFVIII-120 of the complex of D'D3/scFVIII-120 and D'D3
AEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGSLVPRGSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 20 - protein, 1248 aa, Artificial Sequence
  D'D3 of the complex of D'D3/scFVIII-120 and D'D3
AEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 21 - protein, 2465 aa, Artificial Sequence
  scFVIII/D'D3/Fc-120 of the complex of scFVIII/D'D3/Fc-120Fc and Fc
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 227 aa, Artificial Sequence
  Fc of the complex of scFVIII/D'D3/Fc-120 and Fc
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 1980 aa, Artificial Sequence
  dcFVIII/D'D3/D'D3-HC Heavy chain
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDF

SEQ ID NO: 24 - protein, 772 aa, Artificial Sequence; identical to SEQ ID NO: 5
  dcFVIII/D'D3/D'D3-HC Light chain

SEQ ID NO: 25 - protein, 2722 aa, Artificial Sequence
  scFVIII/D'D3/Fc/Fc-120
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 1700 aa, Artificial Sequence
  dcFVIII/D'D3/Fc-HC/Fc-LC Heavy chain
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 1029 aa, Artificial Sequence
  dcFVIII/D'D3/Fc-HC/Fc-LC Light chain
ATDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 1700 aa, Artificial Sequence; identical to SEQ ID NO: 26
  dcFVIII/D'D3/Fc-HC, Fc Heavy chain

SEQ ID NO: 29 - protein, 772 aa, Artificial Sequence; identical to SEQ ID NO: 5
  dcFVIII/D'D3/Fc-HC, Fc Light chain

SEQ ID NO: 30 - protein, 1957 aa, Artificial Sequence
  dcFVIII/D'D3/Fc/Fc-HC Heavy chain
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKCQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 772 aa, Artificial Sequence; identical to SEQ ID NO: 5
  dcFVIII/D'D3/Fc/Fc-HC Light chain

SEQ ID NO: 32 - protein, 1443 aa, Artificial Sequence; identical to SEQ ID NO: 4
  dcFVIII/D'D3-HC/Fc-LC, Fc Heavy chain

SEQ ID NO: 33 - protein, 1029 aa, Artificial Sequence; identical to SEQ ID NO: 27
  dcFVIII/D'D3-HC/Fc-LC, Fc Light chain

SEQ ID NO: 34 - protein, 1443 aa, Artificial Sequence; identical to SEQ ID NO: 4
  dcFVIII/D'D3-HC/Fc/Fc-LC Heavy chain

SEQ ID NO: 35 - protein, 1286 aa, Artificial Sequence
  dcFVIII/D'D3-HC/Fc/Fc-LC Light chain
ATDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYLVPRGSGGGGSGGGGSGGGGSGGGGSGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 10 aa, Artificial Sequence
  Thrombin site
DFLAEGGGVR

SEQ ID NO: 37 - protein, 7 aa, Artificial Sequence
  Thrombin site
TTKIKPR

SEQ ID NO: 38 - protein, 6 aa, Artificial Sequence
  Thrombin site
LVPRGS

SEQ ID NO: 39 - protein, 11 aa, Artificial Sequence
  FVIIa site
ASKPQGRIVGG

SEQ ID NO: 40 - protein, 4 aa, Artificial Sequence
  FXa site
IDGR

SEQ ID NO: 41 - protein, 4 aa, Artificial Sequence
  FXa site
IEGR

SEQ ID NO: 42 - protein, 10 aa, Artificial Sequence
  FXa site
SKLTRAETVF

SEQ ID NO: 43 - DNA, 6999 bp, Homo sapiens
  gene (1)..(6999): mature FVIII
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactga

SEQ ID NO: 44 - DNA, 8376 bp, Homo sapiens
  gene (1)..(8376): full length vWF
gcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcaccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgactgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaactgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 45 - DNA, 4749 bp, Artificial Sequence
  Single chain FVIII with partial B domain
  misc_feature (2344): W= A or T
  misc_feature (2345): K= T or G
  misc_feature (2346): W= A or T
  misc_feature (2344)..(2346): encoding Isoleucine or Cysteine
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaawkwcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgataa

SEQ ID NO: 46 - DNA, 4335 bp, Artificial Sequence
  dcFVIII/D'D3-HC Heavy chain
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 47 - DNA, 2322 bp, Artificial Sequence
  dcFVIII/D'D3-HC light chain
gccaccgatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgataa

SEQ ID NO: 48 - DNA, 6288 bp, Artificial Sequence
  scFVIII/D'D3-6
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 49 - DNA, 6300 bp, Artificial Sequence
  scFVIII/D'D3-10
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 50 - DNA, 6330 bp, Artificial Sequence
  scFVIII/D'D3-20
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 51 - DNA, 6360 bp, Artificial Sequence
  scFVIII/D'D3-30
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 52 - DNA, 6390 bp, Artificial Sequence
  scFVIII/D'D3-40
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggttcaggaggtggaggttcaggaggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 53 - DNA, 6420 bp, Artificial Sequence
  scFVIII/D'D3-50
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggttcaggaggtggaggttcaggaggtggaggttcaggaggtggaggttcaggaggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 54 - DNA, 6450 bp, Artificial Sequence
  scFVIII/D'D3-60
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 55 - DNA, 6540 bp, Artificial Sequence
  scFVIII/D'D3-90
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 56 - DNA, 6630 bp, Artificial Sequence
  scFVIII/D'D3-120
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggttccgcgtggatccgggggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 57 - DNA, 6630 bp, Artificial Sequence
  scFVIII/D'D3-120-TH1
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggtggaggttcactggttccgcgtggatccgggggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggtggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 58 - DNA, 6630 bp, Artificial Sequence
  scFVIII/D'D3-120-TH1
gccactagaaggtactacctgggggctgtggagctgtcctgggattacatgcagtccgacctgggagagctgcccgttgatgctagattcccacctagggtgcccaaatctttcccctttaatacatctgtggtgtacaaaaagacactgtttgtggagtttaccgatcacctcttcaatattgccaagcctcgaccaccctggatgggtctccttggccctacaattcaggccgaggtctacgacaccgtggtaatcaccctgaagaacatggcatcacaccccgtgagcctgcacgctgtgggcgtgtcttactggaaggccagtgaaggcgccgaatatgatgaccagacaagccagagagaaaaggaggacgataaggtgttccctggcggatctcacacatatgtgtggcaggtgctgaaggagaatggacccatggcatctgaccccctttgcctaacttatagttatctttcccatgtggaccttgtcaaggacctgaattctgggcttatcggagcactgctcgtgtgtagagagggttcattggctaaggagaagactcagacactgcacaagttcatcctgctgttcgctgtcttcgatgaggggaagtcttggcacagcgaaaccaagaattccctgatgcaagatcgcgatgccgcatccgctcgcgcatggcctaagatgcatacagtgaatgggtacgtcaatagatccttgcctggcctgattggctgtcacagaaaatctgtgtactggcacgtgattggtatggggaccaccccagaagtgcatagtatctttttggaagggcatacctttctggtgcggaaccacagacaggcctccctggaaattagtccaatcacattcctgacagcccagacactgctgatggatctggggcagtttctcctgttctgtcatatctctagccaccagcatgacgggatggaggcctatgtgaaggtggatagttgtccagaagagcctcagttgagaatgaagaacaacgaggaggctgaagactatgatgatgatttgaccgactctgaaatggatgttgtcagatttgacgacgataatagcccaagctttatccagatcagatcagtggcaaagaagcaccctaagacctgggtgcattatatcgctgccgaagaggaggactgggactacgcccctcttgtgctggcccctgacgataggagctataagtcacagtacctcaacaacggacctcagcgaattggccggaagtataaaaaggttcggtttatggcttacaccgatgaaaccttcaagactagggaggccattcaacacgagtccggtattctcggccccctcctgtatggcgaagtgggggacacactgctgatcatctttaagaaccaggcttcccgcccctacaacatctaccctcacggtattaccgatgtgcggccactgtattctaggagactccctaaaggagtgaagcacctcaaagatttccctattctgcctggtgagatctttaaatacaaatggaccgtcaccgtggaggatgggcccacaaaatccgaccccaggtgtctgaccaggtattatagtagctttgttaatatggagagggatctcgccagcggactgatcggacccctgctgatttgctacaaggaatctgttgatcagagaggtaaccagatcatgagtgataagagaaacgtgatactgttttcagtgttcgatgaaaacagatcatggtacttgactgaaaatattcagcggtttctgccaaaccccgctggagttcagcttgaggaccctgaatttcaagctagtaacatcatgcacagcattaatggatatgtttttgattcattgcagctgtctgtttgcctgcacgaggtggcctattggtatattcttagcattggtgctcagactgacttcctgtccgtgttctttagcgggtacaccttcaagcacaagatggtctatgaggacacattgactctctttccattctccggtgagactgtctttatgtctatggagaacccagggttgtggattctgggctgccataactctgattttagaaacagaggcatgacagctctgctaaaggtgagttcttgcgataagaacacaggagactattatgaggacagttacgaagacatctcagcgtaccttctaagtaagaataatgccattgaaccaagaagtttctctcagaattcccgccatccctccacaaggcagaaacagttcaacgccacaactatccctgagaatgatattgaaaagacagacccttggttcgctcacagaactccaatgcctaaatgccagaatgtctcctcaagcgacctgctgatgctgctgagacagagccccacccctcacgggttgtccctctctgacctgcaggaagcaaagtatgagacttttagcgatgatccctccccaggagcaattgactctaacaattccctgagtgagatgacccacttcagaccacagttgcaccatagcggcgacatggttttcacacctgaaagcggcctgcagcttcgtctgaatgagaagctcggcacaacagctgcaactgaacttaagaaactcgattttaaagtgagctccaccagtaataatctgatctccaccatccctagcgataacttggccgccgggacagataatacttctactctgcagagtgaccaggaggaaatcgactatgacgatactattagcgtggagatgaagaaggaagattttgatatctatgacgaagatgagaatcagagccccaggtcttttcagaaaaagaccagacactatttcatcgcagctgtcgagcggttgtgggactacggcatgtctagttctccccatgtgctcaggaacagggcccagtctggcagcgtccctcagttcaagaaggtcgtgttccaggaattcactgacggctcttttacacagccactgtatcgtggagagctcaatgaacatctgggtctgctgggtccctacattcgcgcagaagtggaggataacatcatggtgactttcagaaatcaggcaagtagaccttacagcttctactcaagcttaattagttacgaggaggaccagagacaaggcgctgagcctaggaagaactttgttaaacctaatgagacaaagacctacttctggaaggtgcagcatcatatggctcctacaaaggatgagttcgactgtaaagcatgggcttacttttcagatgtggatctggaaaaggacgttcattcgggtctgatcggacctctactggtgtgccacaccaacaccctaaacccagctcatggacgacaggtgacagtgcaggaattcgctctgttctttaccatcttcgatgagactaagtcatggtacttcactgaaaatatggagcgtaattgtcgagctccatgtaacattcagatggaggatcctactttcaaagagaattacagatttcatgccattaatggctatattatggatactctgccaggcctggtcatggcccaggatcagaggattcgatggtacctgctcagtatgggtagcaatgaaaacattcattcaatccatttttctggtcatgtgttcactgtgagaaagaaagaggagtataaaatggctctgtataatctgtatcctggagtgtttgagacagttgaaatgctgccctcaaaagcaggtatctggagagtggaatgcttgatcggtgagcatctgcatgccggtatgagcaccctgttcttggtctactccaataagtgtcagacgcctctggggatggccagcgggcacatccgagatttccagatcaccgccagcggacagtacggacagtgggcaccaaagctggccaggctccactatagcggctctatcaacgcgtggtccactaaagaaccctttagctggatcaaagtcgatctgttggccccaatgatcatccatgggattaagactcagggtgctaggcagaaattcagcagcctgtacatatcccagttcatcattatgtatagcttggacggaaagaaatggcagacatatagagggaactctaccggcaccttaatggtgttcttcggaaacgtcgacagcagcggcattaagcataatatctttaatcccccaatcattgctcgttatattaggctccaccctacccattattctatccggagtaccctgcgaatggaactgatgggctgtgaccttaatagctgctctatgcctctcggcatggaatctaaagcaatttccgacgcccagatcacagcctcttcctactttacaaacatgttcgcaacctggtctccatctaaggcaagactgcacttgcagggccggagtaatgcttggaggcctcaggtgaacaatcccaaagagtggctgcaggttgattttcagaagacaatgaaggtgactggggtgaccacacaaggtgttaagagcctgttaacatctatgtacgtgaaggagtttctgatcagctcttctcaggatggccatcaatggaccctatttttccagaacggaaaagttaaggtgttccagggaaaccaggacagctttacccccgtggtgaatagtttggaccctccactcctgacacgttatcttaggatccacccacaaagctgggttcatcagattgccctgagaatggaagtcctggggtgcgaggcacaggacctgtacgggggaggttctctcgtgccaagaggtagtggagggggcggatccggaggaggtggcagcggcggaggaggatctggagggggcgggtcaggggggggcggctccggcggtggtggaagcggaggcgggggaagcggcggcggagggagcggaggtggcggatccggcgggggcggcagcggcggaggtggtagcggggggggtggctctggtggagggggatctggcggtggcggcagtggagggggaggttctggaggcggcggatctggaggaggaggatcaggcggcggaggtagtggaggagggggaagcggcggcggaggcagcggtggcggtggctcaggcggcggaggaggttcactcagttgcaggcctcccatggtgaaactggtgtgtcccgctgataacctgagggccgagggactggagtgcactaagacatgccaaaactacgatctggagtgtatgagcatgggatgtgtgagtggctgtctatgtcctcctggcatggtgcggcacgagaatcggtgcgtcgctctagagcgttgtccatgcttccaccagggcaaggagtacgctcctggcgagacagtaaaaatcggttgtaacacttgtgtttgcagagataggaagtggaactgtacagatcacgtctgcgacgccacatgttccactattggcatggctcactacctgaccttcgacggtctgaagtatctgttccctggcgaatgtcagtatgtgctggtacaggattactgcgggagtaatcccggtacttttaggatcctggtcggaaataagggttgtagtcacccttccgtaaagtgtaagaaacgggtgaccatccttgtcgaggggggggaaatcgagctgtttgacggcgaggtgaatgtgaagaggcctatgaaggatgagactcattttgaggtggtggagtctggccgctatattattctgctgctcggcaaagcactctctgttgtgtgggatcggcacctgtcaatcagcgtggtgcttaagcagacataccaggagaaagtgtgcggcctctgtggaaacttcgacgggatccagaacaatgatctgaccagctctaatctccaggtggaggaggatccagtggactttggaaattcctggaaagtgagttcccagtgtgcagacaccagaaaggtccctctggactctagccccgctacctgtcacaataacatcatgaagcagacaatggttgacagctcttgtcgcattttgactagtgatgtgttccaggattgtaataagctggttgacccagaaccctatttggatgtgtgtatctatgacacatgctcttgtgagtctatcggtgactgtgcctgtttctgcgatacaatcgccgcttacgcgcatgtttgcgcacagcacggtaaagtggtaacttggcgaacggcaacactttgtccccagtcctgtgaggaacgtaatcttcgtgaaaacggctatgagtgtgagtggcgatataatagctgcgcgccagcatgtcaagtgacatgccagcatcctgagcctctagcttgtccagtgcagtgcgttgagggttgccatgctcactgtccacccggcaagattctggatgaacttctgcagacatgcgtggatccagaggattgtccagtttgtgaagtggccggccgtaggtttgctagtggtaaaaaggtgaccctgaatcccagtgacccagagcattgccagatctgccactgcgacgtggtgaacctgacatgtgaagcttgccaggaacctggagggctggttgtgcctcctaccgacgcaccagtgtctcccactacactgtatgtggaggatatcagtgagccacctctgcatgatttctgataa

SEQ ID NO: 59 - DNA, 6630 bp, Artificial Sequence
  scFVIII/D'D3-120-TH1
gccaccagaagatattacctgggcgccgtggaactgtcctgggactacatgcagtctgatctgggcgagctgcccgtggatgccagatttcctccaagagtgcccaagagcttccccttcaacacctccgtggtgtacaagaaaaccctgttcgtggaattcaccgaccacctgttcaatatcgccaagcctagacctccttggatgggcctgctgggacctacaattcaggccgaggtgtacgacaccgtggtcatcaccctgaagaacatggcttctcaccccgtgtctctgcacgccgtgggagtgtcttattggaaggcttctgagggcgccgagtacgacgatcagaccagccagagagagaaagaggacgacaaggttttccctggcggctcccacacctatgtgtggcaggtcctgaaagaaaacggccccatggcctctgatcctctgtgcctgacctactcctacctgtctcacgtggacctggtcaaggacctgaattctggactgatcggcgctctgctcgtgtgcagagagggaagcctggccaaagaaaagacccagacactgcacaagttcatcctgctgttcgccgtgttcgacgagggcaagtcctggcactccgagacaaagaactctctgatgcaggacagggacgccgcctctgctagagcttggcctaagatgcacaccgtgaacggctacgtgaacagatccctgcctggcctgatcggatgccacagaaagtctgtgtactggcacgtgatcggcatgggcacaacacctgaggtgcactccatctttctggaaggccacaccttcctcgtgcggaaccatagacaggccagcctggaaatctcccctatcacctttctgaccgctcagaccctgctgatggatctgggccagtttctgctgttctgtcacatctccagccaccagcacgacggcatggaagcttacgtgaaggtggacagctgccccgaggaaccccagctgagaatgaagaacaacgaggaagccgaggactacgacgacgacctgaccgactctgagatggatgtcgtcagattcgacgacgataactcccctagcttcatccagattcggagcgtggccaagaagcaccctaagacttgggtgcactatatcgccgccgaggaagaggattgggattacgctcctctggtgctggcccctgacgacagatcctacaagtcccagtacctgaacaacggccctcagcggatcggccggaagtataagaaagtgcggttcatggcctacaccgacgagacattcaagaccagagaggctatccagcacgagtccggaattctgggacctctgctgtatggcgaagtgggcgacacactgctgatcatcttcaagaaccaggcctctcggccctacaacatctaccctcatggcatcacagacgtgcggcctctgtactctagaaggctgcctaagggcgtgaagcacctgaaggacttccctattctgcccggcgagatcttcaagtacaagtggaccgtgaccgtggaagatggccccaccaagtctgaccctagatgtctgacccggtactactcctccttcgtgaacatggaaagagatctggcctccggcctgattggccctctgctgatctgctacaaagaatccgtggaccagcggggcaaccagatcatgtccgacaagcggaacgtgatcctgttctctgtgttcgatgagaaccggtcctggtatctgaccgagaacatccagcggtttctgcccaatcctgctggcgtgcagctggaagatcctgagttccaggcctccaacatcatgcacagcatcaacggctatgtgttcgactccctgcagctgtctgtgtgtctgcacgaggtggcctactggtacatcctgtctatcggagcccagaccgacttcctgtccgtgttcttctccggctacaccttcaagcacaagatggtgtacgaggacaccctgacactgttccctttctccggcgaaaccgtgttcatgtccatggaaaaccccggcctgtggatcctgggctgccacaactctgacttccggaacagaggcatgaccgctctgctgaaggtgtcctcctgtgacaagaacaccggcgactactacgaggactcttacgaggatatctccgcctacctgctgtccaagaacaatgccatcgagccccggtccttcagccagaactctagacacccttccaccagacagaagcagttcaacgccaccaccattccagagaacgacatcgaaaagaccgatccttggtttgcccacagaacccctatgcctaagtgccagaacgtgtcctccagcgacctgctcatgctgctgagacagtctccaacacctcacggcctgtctctgtctgacctgcaagaggctaagtacgagactttcagcgacgacccttctcctggcgccatcgactctaacaactccctgtccgagatgacccacttcagacctcagctgcaccactccggcgatatggtgtttacccctgagtctggcctgcagctcagactgaatgagaagctgggcaccaccgctgccaccgagctgaagaaactggacttcaaggtgtccagcacctccaacaacctgatcagcacaatcccttccgacaacctggccgctggcaccgataatacctctacactgcagtccgaccaagaggaaatcgattacgacgacaccatcagcgtcgagatgaagaaagaagatttcgacatctacgacgaggacgagaaccagtctcctcggagcttccagaagaaaaccagacactactttatcgccgctgtggaacggctgtgggactacggaatgtcctcttctcctcacgtgctgcggaatagagcccagtctggctccgtgcctcagttcaagaaagtggtgttccaagagttcaccgacggcagcttcacccagcctctgtatagaggcgagctgaacgagcatctgggactgctgggcccttatatcagagccgaggtcgaggataacatcatggtcaccttcagaaaccaggccagcagaccctactccttctactccagcctgatctcctacgaagaggaccagagacaaggcgccgagcctcggaagaacttcgtgaagcctaacgagactaagacctacttttggaaggtgcagcaccacatggctcctaccaaggacgagttcgattgcaaggcctgggcctacttctccgatgtggatctggaaaaggacgtgcactccgggctgatcggaccactgcttgtgtgtcacaccaacacactgaaccctgctcacggcaggcaagtgacagtgcaagagttcgccctgttcttcaccatcttcgacgaaacaaagtcctggtacttcaccgaaaacatggaacggaactgcagagccccttgcaacatccagatggaagatcccaccttcaaagagaactaccggttccacgccatcaatggctacatcatggataccctgccaggcctcgtgatggctcaggatcagcgcatcagatggtatctgctgagcatgggctccaacgagaatatccactccatccacttcagcggccacgtgttcaccgtgcggaaaaaagaagagtacaagatggctctgtacaatctgtaccccggcgtgttcgagacagtggaaatgctgccttctaaggccggcatctggcgcgtggaatgtctgatcggagagcatctgcatgccggaatgtctaccctgttcctggtgtactccaacaagtgtcagacccctctcggcatggcttccggccatatcagagacttccagatcaccgcttccggacagtatggccagtgggctcctaagctggccagactgcactactctggctccatcaacgcctggtctaccaaagagcccttcagctggatcaaggtggacctgctggctcccatgatcatccacggcatcaagacacagggcgctagacagaagttcagctccctgtacatctcccagttcatcatcatgtactccctggacggcaagaagtggcagacctacagaggcaactccaccggcacactcatggtgttcttcggcaacgtggactcctccggcattaagcacaacatcttcaaccctccaatcattgcccggtacatccggctgcaccccacacactactccatcagatctaccctgagaatggaactgatgggctgcgacctgaactcctgttctatgcccctcggaatggaatccaaggccatcagcgacgcccagattaccgcctcctcctacttcaccaacatgttcgccacttggagcccctctaaggccaggctgcatctgcagggcagatctaatgcttggcggcctcaagtgaacaaccccaaagagtggctgcaggtcgactttcagaaaaccatgaaggtcacaggcgtgacaacccagggcgtcaagtccctgctgacctctatgtacgtgaaagagttcctgatctctagcagccaggacggccaccagtggaccctgtttttccagaacggcaaagtgaaggtgttccagggcaatcaggattctttcacccctgtggtcaacagcctggatcctccactgctgaccagatacctgcggatccatcctcagtcctgggtgcaccagattgctctgcgaatggaagtgctgggatgtgaagcccaagatctgtacggcggaggctctctggttcctagaggatctggcggtggtggttctggcggcggaggaagcggaggcggaggtagtggtggcggtggaagtggcggtggcggatccggtggcggcggatctggcggaggcggcagcggcggtggtggtagcggcggaggcggctcaggtggcggaggcagtggcggcggaggttcaggcggtggtggaagtggcggcggtggctctggcggtggcggctcaggcggtggtggctccggcggaggcggaagcggcggaggcggcagcggaggcggaggctctggtggcggaggttccggtggcggaggcagcggcggaggcggctctggcggaggtggtggatctttgtcttgtcggcctcctatggtcaagctcgtgtgtcccgccgataatctgagagccgaaggactggaatgcaccaagacctgccagaactacgacctcgagtgcatgtctatgggctgtgtgtccggatgtctgtgccctcctggcatggtccgacacgagaatagatgcgtggccctggaaagatgcccctgcttccaccaaggcaaagagtacgctcctggcgagactgtgaagatcggctgcaacacctgtgtgtgtcgggacagaaagtggaactgcacagaccacgtgtgcgacgccacatgctctaccatcggaatggcccactacctgaccttcgacggcctgaagtacctgtttccaggcgagtgccagtatgtgctggtgcaggactactgtggcagcaaccccggcacctttagaatcctcgtgggcaacaagggctgctctcacccctccgtgaaatgcaagaagcgggtcacaatcctggtcgaaggcggagagatcgagctgttcgacggcgaagtgaacgtgaagcggcccatgaaggacgagacacacttcgaggttgtggaatccggccggtacattatcctgctgctgggcaaagctctgtccgtcgtgtgggatagacacctgtccatttccgtggtgctgaagcagacctatcaagagaaagtgtgcggcctgtgcggcaactttgacggcatccagaacaatgacctgacctccagcaatctccaggtcgaagaggatcccgtggatttcggcaactcctggaaagtgtccagccagtgcgccgacacaagaaaggtgccactggattctagccctgccacctgtcacaacaatatcatgaagcaaaccatggtggactccagctgccggatcctgacatccgatgtgtttcaggactgcaacaagctggtggaccccgagccttacctggacgtgtgtatctacgatacctgctcctgcgagtctatcggcgactgcgcctgcttttgcgacacaatcgctgcttacgcccatgtgtgcgctcagcatggaaaggtggtcacttggagaaccgccacactgtgtccccagtcctgcgaggaaagaaacctgcgcgagaatggctatgagtgcgagtggcggtacaactcttgtgcccctgcctgtcaagtgacctgtcagcatcctgaaccactggcttgtcccgtgcagtgcgtggaaggctgtcatgctcattgcccaccaggcaagatcctggatgagctgctgcagacctgtgtggatccagaggattgtcctgtgtgcgaagtggccggcagaagattcgcctccggaaagaaagtgaccctgaatcctagcgaccctgagcactgccagatctgccactgtgatgtcgtgaacctgacctgcgaggcttgtcaagaacctggcggactggtggtgcctcctacagatgctcctgtgtctcccaccacactgtacgtcgaggacatctctgagccacctctgcacgatttctgatag

SEQ ID NO: 60 - DNA, 6630 bp, Artificial Sequence
  scFVIII/D'D3-120-TH1
gctactcgtcgttactacctgggagctgtcgagctgagctgggattacatgcagtctgacctgggagagctgcctgtggacgctaggtttccacctcgggtgcctaagtccttccccttcaacaccagcgtggtgtataagaagaccctgttcgtggagtttacagatcacctgttcaacatcgctaagcctagaccaccctggatgggcctgctgggcccaacaatccaggccgaggtgtacgacaccgtggtcatcaccctgaagaacatggcttcccaccctgtgagcctgcatgctgtgggcgtgtcctactggaaggccagcgagggcgctgagtatgacgatcagacctctcagcgcgagaaggaggacgataaggtgtttccaggcggctcccatacctacgtgtggcaggtgctgaaggagaatggcccaatggcttctgatcccctgtgcctgacctactcttatctgtcccacgtggacctggtgaaggatctgaacagcggcctgatcggcgctctgctggtgtgcagggagggctctctggccaaggagaagacccagacactgcataagttcatcctgctgttcgccgtgtttgacgagggcaagagctggcactctgagacaaagaattctctgatgcaggacagagatgctgcttccgccagggcttggccaaagatgcatacagtgaacggctacgtgaatagatccctgcctggcctgatcggatgccacaggaagagcgtgtattggcatgtgatcggcatgggcaccacaccagaggtgcactctatcttcctggagggccatacctttctggtgaggaatcaccggcaggcttctctggagatctcccccatcaccttcctgacagcccagaccctgctgatggatctgggccagttcctgctgttttgccacatctccagccaccagcatgatggcatggaggcttacgtgaaggtggactcctgtcctgaggagccacagctgaggatgaagaacaatgaggaggccgaggactatgacgatgacctgaccgactctgagatggatgtggtgaggttcgatgacgataactcccccagctttatccagatccggtccgtggccaagaagcaccctaagacatgggtgcattacatcgccgctgaggaggaggactgggattatgctcctctggtgctggccccagacgatcggtcctacaagagccagtatctgaacaatggcccccagagaatcggccgcaagtacaagaaggtgagattcatggcttatacagatgagacattcaagacacgcgaggccatccagcacgagagcggaatcctgggacctctgctgtacggagaagtgggcgacaccctgctgatcatctttaagaaccaggccagcagaccctacaatatctatcctcatggcatcacagatgtgcgcccactgtactctaggcggctgcccaagggcgtgaagcacctgaaggacttccccatcctgcctggcgagatctttaagtataagtggaccgtgacagtggaggatggcccaaccaagagcgaccccagatgcctgacacgctactattcttccttcgtgaatatggagcgggatctggcttctggcctgatcggaccactgctgatctgttacaaggagtctgtggatcagaggggcaaccagatcatgtccgacaagcggaatgtgatcctgttcagcgtgtttgacgagaacaggtcttggtatctgactgagaacatccagcggttcctgcctaatccagctggcgtgcagctggaggatcctgagtttcaggcctctaacatcatgcattccatcaatggctacgtgttcgacagcctgcagctgtccgtgtgcctgcacgaggtggcttactggtatatcctgtccatcggcgcccagaccgatttcctgtccgtgttctttagcggctacaccttcaagcataagatggtgtatgaggacaccctgacactgttcccattttccggcgagacagtgttcatgagcatggagaatcccggcctgtggatcctgggctgccacaacagcgatttcaggaatcggggcatgaccgccctgctgaaggtgagctcttgtgacaagaacacaggcgactactatgaggatagctacgaggacatctctgcttatctgctgtccaagaacaatgccatcgagcccagatctttttcccagaattctaggcatccttccacccggcagaagcagttcaacgctaccacaatcccagagaatgatatcgagaagaccgacccctggtttgcccataggacacccatgcctaagtgtcagaacgtgtccagctctgatctgctgatgctgctgaggcagtctccaaccccacacggcctgagcctgtctgacctgcaggaggctaagtacgagacattcagcgacgatccttctccaggcgccatcgattccaacaattccctgagcgagatgacccacttcaggcctcagctgcaccatagcggcgacatggtgtttacaccagagtctggcctgcagctgcggctgaacgagaagctgggcaccacagccgctaccgagctgaagaagctggactttaaggtgtccagcacctccaacaatctgatctccacaatccctagcgataacctggccgctggcaccgacaatacctctacactgcagtccgatcaggaggagatcgactacgacgatacaatcagcgtggagatgaagaaggaggacttcgatatctatgacgaggatgagaaccagtctccaagatccttccagaagaagacccgccattactttatcgccgctgtggagaggctgtgggattatggcatgtcttccagccctcacgtgctgagaaatcgcgcccagtctggctccgtgccacagttcaagaaggtggtgttccaggagtttaccgacggcagctttacacagccactgtacagaggcgagctgaacgagcacctgggcctgctgggaccatatatcagggctgaggtggaggataacatcatggtgaccttcagaaatcaggccagccgcccatactctttttattcttccctgatctcttacgaggaggaccagaggcagggagctgagcctcggaagaacttcgtgaagccaaatgagacaaagacatacttttggaaggtgcagcaccatatggcccccaccaaggacgagttcgattgcaaggcctgggcttacttctccgacgtggatctggagaaggacgtgcactccggcctgattggaccactgctggtgtgccataccaacacactgaatcctgctcacggcaggcaggtgaccgtgcaggagttcgccctgttctttaccatctttgatgagacaaagtcctggtacttcacagagaacatggagaggaattgtcgggctccctgcaatatccagatggaggaccctaccttcaaggagaactaccggtttcatgctatcaatggctatatcatggatacactgccaggcctggtcatggcccaggaccagaggatccggtggtacctgctgagcatgggctctaacgagaatatccactccatccatttcagcggccacgtgtttaccgtgagaaagaaggaggagtataagatggccctgtacaacctgtatccaggcgtgttcgagacagtggagatgctgcccagcaaggctggcatctggagggtggagtgcctgatcggagagcacctgcatgccggcatgtctaccctgtttctggtgtactccaataagtgtcagacacctctgggcatggcttctggccatatcagagatttccagatcaccgcttccggacagtacggacagtgggctccaaagctggctcgcctgcactatagcggctctatcaacgcctggtctaccaaggagccattttcctggatcaaggtggacctgctggctcccatgatcatccatggcatcaagacacagggcgccagacagaagttcagctctctgtacatcagccagtttatcatcatgtattctctggatggcaagaagtggcagacctaccgcggcaatagcaccggcacactgatggtgttctttggcaacgtggactccagcggcatcaagcacaacatcttcaatcctccaatcatcgctagatacatccgcctgcaccccacccattattccatcaggagcacactgcggatggagctgatgggctgcgatctgaactcctgtagcatgcctctgggcatggagtctaaggccatctccgacgctcagatcaccgcctcttcctacttcaccaatatgtttgctacatggtccccctccaaggcccggctgcatctgcagggcaggtctaacgcctggcggcctcaggtgaacaatccaaaggagtggctgcaggtggattttcagaagaccatgaaggtgacaggcgtgaccacacagggcgtgaagagcctgctgacctctatgtatgtgaaggagttcctgatcagctcttcccaggacggccaccagtggacactgttctttcagaacggcaaggtgaaggtgttccagggcaatcaggattcctttaccccagtggtgaacagcctggacccccctctgctgacaaggtacctgcggatccacccccagtcctgggtgcatcagatcgctctgagaatggaggtgctgggatgcgaggctcaggacctgtatggaggcggcagcctggtgccccgcggcagtggcggcggcggcagcggcggcggcggctccggcggcggtggttctggtggtggtggttccggtggtggcggctccggcggcggaggttctggtggtggtggatccggtggaggcggctccggcggcgggggttctggtggtggtgggtccggtgggggcggctccggcggcggcggttctggtggtggtggctccggtggcggtggctccggcggcggtggatctggtggtggtggtagcggtggcggaggctccggcggcggtgggtctggtggtggtggttcaggcggcggcggctccggaggaggaggaagcggcggaggaggaggcagcctgtcttgcaggccacccatggtgaagctggtgtgccctgctgataatctgcgggccgagggcctggagtgtaccaagacatgccagaactacgacctggagtgcatgtctatgggatgcgtgtccggatgcctgtgccctccaggcatggtgagacatgagaaccgctgcgtggctctggagagatgcccttgttttcaccagggcaaggagtatgccccaggcgagacagtgaagatcggctgcaatacatgcgtgtgcagggacaggaagtggaactgtaccgatcacgtgtgcgacgctacctgcagcacaatcggcatggcccactacctgacattcgatggcctgaagtatctgtttccaggcgagtgccagtacgtgctggtgcaggactattgtggctctaatcctggcaccttcagaatcctggtgggcaacaagggctgctctcacccatccgtgaagtgtaagaagcgcgtgacaatcctggtggagggcggcgagatcgagctgtttgatggcgaagtgaatgtgaagaggcccatgaaggacgagacacatttcgaggtggtggagtccggccggtacatcatcctgctgctgggcaaggccctgagcgtggtgtgggacaggcacctgtccatcagcgtggtgctgaagcagacctatcaggagaaggtgtgcggcctgtgcggcaactttgatggcatccagaacaatgacctgacaagctctaatctgcaggtggaggaggaccctgtggatttcggcaactcttggaaggtgtccagccagtgcgctgataccaggaaggtgcccctggactcttcccctgccacctgtcacaacaatatcatgaagcagacaatggtggatagctcttgccggatcctgacatccgacgtgttccaggactgtaacaagctggtggaccccgagccttacctggacgtgtgcatctatgacacctgcagctgtgagtctatcggcgattgcgcttgtttctgcgacacaatcgccgcttacgctcacgtgtgcgcccagcatggcaaggtggtgacctggaggaccgccaccctgtgcccacagtcctgcgaggagagaaacctgcgcgagaatggctacgagtgcgagtggcggtataacagctgtgcccccgcttgccaggtgacctgtcagcacccagagcccctggcttgccctgtgcagtgcgtggagggatgccacgctcattgtccacctggcaagatcctggatgagctgctgcagacctgcgtggaccccgaggattgtcccgtgtgcgaggtggctggcagacgcttcgcttccggcaagaaggtgacactgaatccaagcgatcccgagcactgtcagatctgtcattgcgacgtggtgaacctgacctgtgaggcttgccaggagcctggaggcctggtggtgccacccacagacgcccctgtcagcccaactaccctgtatgtggaagatatttcagagccccccctgcacgatttctgataa

SEQ ID NO: 61 - DNA, 6630 bp, Artificial Sequence
  scFVIII/D'D3-120-TH2
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctgagtaaaaacaatgccattgaaccaagagggggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggttcaggaggtggaggtggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 62 - DNA, 7170 bp, Artificial Sequence
  scFVIII/D'D3-300
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatccatcaacgcatggtccaccaaggagccattcagctggatcaaggtggacctcctcgcacctatgatcatccacggcatcaagacccagggcgcaaggcagaagttctccagcctctacatctcccagttcatcatcatgtactccctggacggcaagaagtggcagacctaccgcggcaactccaccggcaccctcatggtcttcttcggcaacgtcgactcctccggcatcaagcacaacatcttcaaccctcctatcatcgccaggtacatccgtctccaccccacccactactccatccgaagcaccctgcgaatggagctcatgggctgcgacctcaactcctgctccatgcccctgggcatggagagcaaggcaatctccgacgctcagatcaccgcatcctcctacttcaccaacatgttcgctacctggagccctagcaaggcccggctccaccttcagggcaggtccaacgcatggcgtccacaggtcaacaaccctaaggagtggctgcaggtcgacttccagaagactatgaaggtcaccggcgtgaccacccagggagtcaagtccctcctcacctccatgtacgtcaaggagttcctcatctcctccagccaggacggccaccagtggaccctcttcttccagaacggaaaggtgaaggtgttccagggaaaccaggactccttcacccccgtcgtcaactccctcgaccccccactcctgacccgttacctgcgtatccatccacagagctgggtccatcagatagccctgagaatggaggtgctgggatgcgaggctcaggacctgtacctggtcccaagaggatctggaggtggaggcagcggcggagggggatcaggcggaggcggatcaggcggcggtggctctggaggtggcggatctggaggaggtggttcaggaggaggtggaagcggtggtggaggttcaggtggaggaggttcaggaggtggtgggtcaggtggggggggatcaggaggtgggggaagtggtggtggaggatctgggggtggtggaagtggtggaggtggtagtggtggaggaggctcaggtggtgggggttctggaggaggaggttctggtgggggaggttcaggcggaggtggaagtgggggtggaggtagtggaggcggtggtagtggcggtggtggcagcggaggaggggggtctggaggaggcggttcaggaggcggagggtctggaggcggaggaagtggggggggtggatcaggagggggaggaagtggcggtggagggagtggaggagggggaagtggaggcggcggttctggagggggcggatctgggggaggaggctctggaggcgggggttcaggaggggggggaagcggcggcggaggcagtggtgggggcggcagtggcgggggcgggagtggtggcggggggtcagggggcggggggagtgggggagggggctcaggcggcggggggagcgggggaggtggttctgggggcgggggctcaggtgggggcgggagcggaggcggtgggtcaggcggaggagggtcaggcggggggggcagtggcggtggggggtctggtggcggtgggagtgggggcggtggtagcggcggtggtggatcaggggggggcggctctggcggcgggggctctggcggaggtggttccgggggcggcgggagcggcggcggtgggtccggcgggggcggcagcctttcttgtcgaccacctatggtaaaacttgtttgtcctgctgataatcttagagcagaaggcttggaatgtacaaaaacttgtcaaaattatgatttggaatgtatgagtatgggctgtgtaagtgggtgtttgtgtcctccaggcatggttcgacatgaaaatcgatgtgtagctcttgaaagatgtccatgttttcatcaaggcaaagaatatgctcctggcgaaactgtaaaaattggctgtaatacatgtgtatgtagagatagaaaatggaattgtacagatcatgtatgtgatgcaacttgttctacaattgggatggcacattatttgacatttgatggcttgaaatatttgtttccaggcgaatgtcaatatgtattggttcaagattattgtggctctaatccaggcacttttaggatacttgttggcaataaaggctgttctcatccaagtgttaaatgtaaaaaaagggttactattcttgttgaaggcggcgaaattgaactttttgatggcgaagttaacgttaaaaggccaatgaaagatgaaacacattttgaggttgttgaaagtggccgctatattattcttttgttggggaaagctctttctgtggtgtgggatcggcatctttctatatctgtggtgttgaaacaaacatatcaagaaaaggtgtgtggcctgtgtggcaactttgacgggattcagaacaacgacctgaccagcagcaacctgcaagtggaggaggaccctgtggactttggcaacagctggaaggtgagctcccagtgcgccgacacccgcaaggtgcctttggactcttctccagctacatgccacaataatattatgaagcagacaatggtggacagcagctgccgcattctgacaagcgacgtgtttcaggactgcaataagctggtggaccccgagccttacctggacgtctgcatatacgacacttgctcctgcgagagcattggcgattgcgcctgcttttgcgatacaattgccgcctacgcccacgtctgcgcccagcacggcaaggtggtgacatggcgcacagccactctgtgccctcagagctgcgaggagcggaatctgcgggagaatggctacgagtgcgagtggcgctataattcctgcgctcccgcctgccaggtcacttgccagcaccccgagcctctggcttgcccagtgcagtgcgtggaaggctgtcatgctcattgccctccaggcaagattctggatgagctgctgcagacatgcgtcgatcccgaggattgccctgtatgcgaggtggctgggcggcggtttgcctctgggaaaaaggtgactctgaatccctctgatcccgagcactgtcaaatatgccactgcgatgtggtgaatctgacttgcgaggcctgtcaagagcccggcggcctggtggtgccccccacagatgcccccgtgtctcccactactctgtatgtggaagatattagcgagccccccctgcacgatttttgataa

SEQ ID NO: 63 - DNA, 8241 bp, Artificial Sequence
  scFVIII/D'D3/D'D3-120
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggaagcatcaacgcatggtccaccaaggagcctttctcctggatcaaggtggacctgcttgcacctatgatcatccacggaatcaagacccagggcgctcgtcaaaagttctcctccctgtacatctcccagttcatcatcatgtactccctggacggaaagaagtggcagacctacaggggaaactccaccggcaccctgatggtcttcttcggaaacgtggactccagcggaatcaagcacaacatcttcaaccctcccatcatcgcccgttacatccgtctccaccctacccactactccatccgttccacccttcgtatggagctgatgggatgcgatctcaacagctgctccatgcccctcggaatggaaagcaaggcaatctccgacgctcaaatcaccgcttcctcctacttcaccaacatgttcgccacctggtccccatcaaaggcacgacttcacctgcaaggacgttccaacgcatggcgacctcaagtaaacaaccctaaggagtggctgcaagtggacttccagaagaccatgaaggtgaccggagtgaccacccaaggagtaaagtccctcctcacctccatgtacgtcaaggagttcctgatctcctcatcacaagacggacatcagtggacccttttcttccagaacggcaaggtgaaggtcttccagggcaaccaggactccttcacccctgtagtcaactccctcgaccctccattgctcacccgatacttgcgaatccatccacagtcctgggttcatcagatcgcactccgaatggaagtcctgggctgtgaggcacaagacctttacctggtgcctagaggaagcggaggcggaggaagtggaggcggtggatctggtggcgggggatctggtggtggaggtagtggtggaggaggttcaggtggaggtggttctggaggtggtggttctggtggcggaggttcaggaggtggaggttcagggggtggtggatcaggaggtggcggttctggtgggggaggatctggaggaggaggcagtggtggtggcggtagtggaggaggtggtagtggtggtgggggttcaggagggggtggttcaggaggaggcggatctggaggtggggggagtggcggaggaggtagtggcggagggggatcaggaggagggggatctggcggtggtgggtcactttcttgtcgacctccaatggtaaaacttgtatgtccagctgataatcttagagcagaaggccttgaatgtacaaaaacatgtcaaaattatgatcttgaatgtatgtctatgggttgtgtatcaggttgtctttgtccacctggaatggtacgacatgaaaatagatgtgtagcacttgaaagatgtccttgttttcatcaagggaaagaatatgctccaggggaaactgtaaaaatagggtgtaatacttgtgtatgcagggatagaaagtggaactgcaccgaccacgtgtgtgacgctacctgttccaccatcggcatggctcattacctgaccttcgacgggcttaaatacctgttccccggggagtgtcaatacgtgcttgtgcaagactactgcggctcaaacccagggacattcagaatcctcgtcggcaacaaggggtgttcccatccttccgttaagtgcaagaagagggtgaccatcctggtggaaggcggggaaatcgaacttttcgacggggaagttaacgtgaagcgcccaatgaaggacgagacccatttcgaggtggtcgaaagcgggagatacatcatcctgctgctcgggaaggctttgtccgttgtttgggacagacacctctccatctcagtggtcctcaagcagacctaccaggaaaaggtgtgcggcttgtgtgggaacttcgacggcatacagaacaacgacctcacctcatcaaatctccaggtcgaggaagaccctgtcgactttgggaacagctggaaggtgagcagccagtgcgcagataccagaaaggttccactcgacagcagcccagcaacttgtcataacaacatcatgaagcagaccatggtggacagcagctgcaggattctgaccagcgacgtctttcaggactgcaacaagctggtcgacccagagccatacctcgacgtttgcatttacgacacatgcagctgcgagagcattggggactgcgcatgcttttgcgacaccattgctgcttacgcccatgtgtgcgctcagcatgggaaggttgttacatggaggacagctacactgtgcccacagagctgcgaagaaagaaacctcagggagaacgggtacgaatgcgagtggaggtacaacagctgcgctccagcatgtcaggtaacttgccagcacccagaacctcttgcttgcccagttcaatgcgttgaagggtgccatgctcattgcccaccaggcaaaattctggacgaactgctccagacttgcgtcgatccagaagactgcccagtatgcgaggttgctggcaggaggtttgcaagtgggaaaaaggttacactcaacccaagcgacccagaacactgccagatatgccactgcgacgttgttaacctgacttgcgaggcatgccaggaacctggcggccttgttgttcctccaacagatgctccagttagcccaacaacattgtatgtggaggacattagcgagccccctttgcacgactttggcgggggaggcagtgggggcgggggcagtggcgggggcggctctggggggggcggctcagggggcggtggtagtggcggcgggggcgggagtttgtcttgtaggcctcctatggtaaaattggtttgtcctgctgataatttgagggctgaagggttggagtgtacaaaaacttgtcagaattatgatttggaatgcatgtctatgggctgtgttagtggctgtttgtgtcctcctggcatggtccggcatgaaaatcggtgtgtggctttggaacggtgtccctgttttcatcagggcaaagagtatgcccctggcgagacagtcaaaattggctgtaatacatgtgtgtgtcgggatcggaaatggaattgtacagatcatgtgtgtgatgccacttgttctactattggcatggcccactatttgacttttgacggcctgaagtatctgtttcccggcgagtgccagtatgtgctggtgcaggactattgcggcagcaaccctggcacatttcgcatactggtggggaataagggctgcagtcaccctagtgtgaagtgcaagaaacgcgtgactattctggtggaggggggcgaaattgagttgtttgacggcgaggtgaatgtgaagcggcctatgaaggatgagactcactttgaggtggtggagagcggccggtatattatactcctgctgggcaaagccctgagcgtcgtgtgggatcgccacttgtctattagcgtggtgttgaaacagacttatcaggagaaagtctgcgggctgtgcggcaattttgatgggattcagaataatgatctgactagcagcaatctgcaggtggaagaagatcccgtcgattttggcaatagttggaaagtgtcttctcagtgcgccgatacacggaaagtgcccctggatagtagtcccgccacatgccacaataatattatgaaacagacaatggtggatagttcttgccgcattctgacttctgatgtgtttcaggattgcaataaactggtcgatcccgagccctatctggatgtgtgcatatatgatacttgctcttgcgagtctattggcgattgcgcctgcttttgcgatacaattgccgcctatgcccacgtgtgcgcccagcacggcaaagtcgtcacttggcggactgccactctgtgcccccagtcttgcgaggagcgcaatctccgcgagaatggctatgagtgcgagtggcgctataattcttgcgcccccgcctgccaggtgacttgtcagcaccccgagcccctggcctgtcccgtgcagtgtgtggagggctgtcacgcccactgtccccccggcaaaattctcgatgagctgctgcagacatgtgtggaccccgaggattgtcccgtctgtgaggtggccggccggcgctttgcctctggcaaaaaagtcacactgaatccctctgatcccgagcactgtcagatatgtcattgtgatgtcgtcaatctcacttgtgaggcctgtcaggagcccggcggcctggtggtgcctcccacagatgcccccgtgtctcccacaactttgtatgtcgaggatatttctgagccccccctgcatgatttttgataa

SEQ ID NO: 64 - DNA, 8853 bp, Artificial Sequence
  D'D3/scFVIII-120
gcagaaggaacccgtgggagatcctccacagcacgttgttcccttttcggctccgacttcgtcaacaccttcgacggctccatgtactccttcgccggatactgctcatacctgctcgcaggagggtgccagaagcgttctttctccatcatcggagacttccagaacggaaagcgtgtctccctgtccgtctacctgggggaattcttcgacatccacctcttcgtcaacggaaccgtcacccagggagaccagcgtgtcagtatgccttacgcatccaagggactttacctggagaccgaggcaggatactacaagctcagcggagaggcatacggcttcgtcgcaagaatcgacggctccggcaacttccaggtgctgctctccgaccgttacttcaacaagacctgcggtctttgcggtaacttcaacatcttcgccgaggacgacttcatgacccaggagggcacccttacctcagacccatacgacttcgcaaacagctgggctctttcctccggagagcagtggtgtgagcgagcatctcctcctagttcttcctgtaacatctccagcggtgagatgcagaagggtctgtgggagcagtgtcagctcttgaagtcaacctccgtcttcgcacgatgccacccattggtcgatcctgagccattcgtagctctttgcgagaagaccctctgcgaatgcgcaggaggtcttgaatgcgcatgtccagcattgctcgagtacgcacgaacttgcgcacaagagggtatggtactctacggttggaccgaccattcagcatgctccccagtatgcccagcaggaatggaataccgacagtgtgtatccccatgtgctcgaacctgtcagtccctccacatcaacgagatgtgccaggagcgatgtgtcgacggttgttcatgccctgagggacaacttctcgacgagggtttgtgtgtcgagagtaccgagtgtccatgcgtacactcaggaaagcgatacccaccaggtacctccctttcaagagactgcaacacctgcatctgcaggaacagccagtggatctgctccaacgaggagtgccctggtgaatgtcttgtcaccggtcagtcacacttcaaaagcttcgacaaccgctacttcaccttctccggcatctgccagtacctgctcgctcgagactgccaggatcactcattctccatcgtgatcgagaccgtgcagtgcgctgatgacagagacgctgtctgtacccgatcagtaaccgtcagactgccaggtctccataactcccttgtcaagctcaagcacggtgctggtgtagctatggacggtcaggacgtacagctccctttgctcaagggagaccttagaatccagcacaccgtaaccgcttcagtgagactcagctacggtgaggaccttcagatggactgggacggtagaggtagactgctcgtcaagctctcaccagtatacgccggtaagacctgcggactttgcggtaattacaacgggaaccagggtgacgacttcctgaccccatcaggtcttgctgagcctagagtcgaagacttcggtaacgcttggaagctgcacggagactgccaagacctccagaagcagcactcagacccatgtgctttgaaccctagaatgaccaggtttagcgaggaggcctgcgctgtcttgacctccccaacttttgaggcttgccacagagctgtaagcccattgccatacctgagaaactgcaggtacgacgtctgcagctgtagcgacggtagggagtgtctttgcggagctttggcttcctacgctgcagcatgtgctggaaggggagttagggtagcttggagggaaccaggaaggtgtgaattgaactgcccaaagggacaggtctacttgcagtgcggaactccttgcaacttgacttgcaggtccctgagctacccagacgaggagtgtaacgaggcttgcttggagggatgtttttgcccaccaggattgtacatggacgagcggggagactgcgttccaaaggctcagtgtccatgctattatgacggcgagatctttcagcccgaggacatctttagcgaccaccacactatgtgctattgcgaggacggctttatgcactgcacaatgagcggggtgcctggcagcctgttgccagacgccgttttgagcagccctttgagccataggagcaagaggagcttgagctgcaggcctcctatggttaagttggtgtgccctgccgataacttgagggccgaaggattggagtgtacaaagacttgccagaactatgatctggagtgcatgagcatgggctgcgtgagcgggtgcctgtgccctcccggaatggttaggcatgaaaaccgctgtgttgccctggaacggtgtccttgttttcaccaaggaaaggagtatgcccctggagagacagttaagatcgggtgcaatacttgcgtgtgccgcgatcggaagtggaattgcacagatcacgtgtgcgatgccacatgcagcacaatcgggatggcccactatctgacatttgatggcctgaagtatctgtttcccggcgagtgccagtatgtgctggtgcaggattattgcggcagcaatcccgggacttttcggatactggtgggcaataagggctgcagtcaccccagcgtgaagtgcaagaagcgcgtgacaattctggtcgagggcggagagattgagctgtttgatggcgaggtgaatgtcaaacggcccatgaaagatgagactcactttgaggtggtggagagtgggcggtatataatactgcttcttgggaaagccctgagtgtggtgtgggatcgccatctgtctatatctgtggtgctgaaacagacttatcaggagaaagtgtgcgggctgtgcgggaattttgatggcattcagaataatgatctgactagtagtaatctgcaggtggaagaagatcccgtggattttggcaattcttggaaagtgtcttctcagtgtgccgacacacggaaagtgcccctggattcttctcccgccacttgtcataataatataatgaaacagactatggtggattctagttgtcgcattctgactagtgatgtgtttcaggattgtaataaactggttgatcccgagccctatctggatgtgtgtatttatgatacatgtagttgtgaaagtattggcgattgtgcctgtttttgtgatacaattgccgcctatgcccatgtgtgtgcccagcatggcaaagtggtgacatggcgcacagccacactctgtccccaaagctgtgaagaacgcaatctgcgggaaaatggctatgaatgtgaatggcgctataattcttgtgcccccgcctgtcaagtgacatgtcaacatcccgaacccctggcctgtcctgtgcaatgtgtggaaggctgtcatgctcattgtccccctgggaaaattctcgacgaactcctgcaaacatgtgttgatcccgaagattgtcccgtgtgtgaagtggccgggcgccgctttgccagtggcaaaaaagtgactctgaatcccagtgatcccgaacattgtcaaatttgtcattgtgatgtggtgaatctgacatgtgaagcttgtcaagaaccaggcgggctcgtggtgcctcccacagatgcccccgtgtctcccacaactctgtatgtggaagatatttctgaaccccctctgcatgattttggaggcggcggaagtggcggcggaggcagcggaggcggggggtctgggggtggtggatctggcgggggcgggagtggcggaggagggtctggcggcgggggcagcggcggtggtgggagtggaggcgggggctcagggggcgggggatcaggcgggggcggctcaggcggaggtggttcagggggtggtggcagtggggggggcgggtctgggggcggaggaagtgggggcggcgggtctggcggagggggatctggaggcggtggctctggtggagggggctctggcggtggtggctctgggggcggggggagtggcggcggtggctcaggcggtggtagtctcgttcctcggggctctgccacacggcggtattatctgggcgccgttgaactctcttgggattatatgcaatctgatctcggcgaactgcctgttgatgcccgctttcctcctcgggttcctaaatcttttccctttaatacatctgttgtttataaaaaaactctgtttgttgaatttactgatcatctgtttaatattgccaaaccccggcccccctggatgggcctgctgggccccacaattcaagccgaagtttatgatactgttgtgattactcttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgataa

SEQ ID NO: 65 - DNA, 3750 bp, Artificial Sequence
  D'D3
gcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 66 - DNA, 7401 bp, Artificial Sequence
  scFVIII/D'D3/Fc-120
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatctatcaacgcatggagcaccaaggagccattctcctggatcaaggtggacctcctcgctcctatgatcatccacggcatcaagacccagggcgctagacagaagttcagcagcctctacatctcccagttcatcatcatgtactccctggacggcaagaagtggcagacctaccgcggaaactccaccggaaccctcatggtcttcttcggaaacgtggacagctccggtatcaagcacaacatcttcaacccccctatcatcgcacgttacatccgtctgcaccctacccactactccatcaggagcaccctcagaatggagctgatgggttgcgacctcaactcctgctccatgccactcggaatggagtcaaaggcaatctccgacgcacaaatcaccgcatcctcctacttcaccaacatgttcgccacctggtcaccaagtaaggcaaggctccacctccaaggacgttcaaacgcatggcgtccacaagtcaacaacccaaaggagtggctccaagtggacttccagaagacaatgaaggtgaccggcgtgaccacccaaggagtcaagtcactgctcacctccatgtacgtcaaggagttcctgatctccagctcccaagacggccaccaatggacccttttcttccagaacggcaaggtgaaggtcttccagggtaaccaggactccttcaccccagtcgtcaactccctcgatccaccacttcttaccagatacctccgaatccaccctcaaagctgggtccaccaaatcgcacttcgaatggaggtcctgggatgcgaagcacaagatctgtacctggtcccacgtggaagtggtggtgggggaagtggtggaggtggtagtggaggtggaggatctggtggtggaggttcaggtggagggggaagtggaggtggtgggtctggtggaggaggtagtggtggcggaggttctggaggtgggggatcaggtggtggaggatcaggaggaggtggatcaggtgggggaggatcaggcggaggtggttctggagggggtgggagtggaggaggcggatcaggaggcggtggctcaggaggaggcggctcaggaggcggaggatctgggggagggggctcaggaggtgggggttcagggggcggtggttctgggggcggggggtctggcggcggaggctctctttcatgtcgaccacctatggttaaacttgtatgtcctgcagataatcttagagctgaagggcttgaatgtacaaaaacttgtcaaaattatgatcttgaatgtatgtcaatggggtgtgttagtgggtgtctttgtcctcctgggatggttagacatgaaaatcgatgtgtagctttggaaagatgtccatgttttcatcaaggcaaagaatatgcaccaggcgaaacagtaaaaattgggtgtaatacatgtgtatgtcgagatcgaaaatggaattgtactgatcatgtttgtgatgcaacctgtagtaccatcggcatggctcactaccttaccttcgacgggttgaagtacctgttccctggggaatgccagtacgtactcgtccaggattactgcgggtctaaccctgggacatttagaattctggtcggcaacaagggctgctcccacccaagtgtcaagtgcaagaagagggtcaccattctggtcgagggcggcgaaatagaactgttcgacggggaagtaaacgtgaagaggccaatgaaggacgagacccacttcgaggtggtggaatccgggagatacattattctgctcctcgggaaggccctgagtgtcgtatgggacaggcacctttccattagcgtcgtcctcaagcagacctaccaggaaaaggtctgcggcctttgtgggaactttgacggcatacagaacaacgacctgacctccagcaacctgcaggtagaggaagacccagtagactttgggaacagctggaaggtctcctcccagtgtgctgacaccaggaaggtccctcttgactctagtccagctacctgtcacaacaacattatgaagcagaccatggtggacagcagctgccggattctcacttccgacgtgtttcaggactgcaacaagctggttgaccctgagccctacctggacgtgtgtatttacgacacatgctcctgcgagagcattggcgactgcgcttgcttttgcgacacaatagccgcctatgcccacgtgtgtgctcagcacggcaaagtggtgacttggaggacagctacactgtgtcctcagagttgtgaggagaggaacctgcgggaaaatggctatgagtgcgaatggcggtataatagctgcgccccagcttgtcaggtgacttgtcagcacccagaaccactggcttgtcctgtgcagtgtgttgaaggctgccatgctcattgcccaccaggcaaaattctggacgaactgctgcagacatgcgttgatcctgaggattgccctgtatgcgaagtggctggccggcggtttgcttctggcaaaaaagttactctgaatccctccgatcctgagcactgccagatatgccattgcgatgtggtgaatctgacttgcgaggcctgccaggaacctgggggcttggttgttcctcctacagatgcccctgttagtcctactactctgtatgtggaggatattagcgagccccctctgcatgattttggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 67 - DNA, 687 bp, Artificial Sequence
  Fc
gacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 68 - DNA, 5946 bp, Artificial Sequence
  dcFVIII/D'D3/D'D3-HC Heavy chain
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttcggcggtggggggtcaggcggaggcggcagtggcggcgggggctctggcggaggtgggtccggcggtggcggttctggcgggggcggcggcagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctgataa

SEQ ID NO: 69 - DNA, 2322 bp, Artificial Sequence; identical to SEQ ID NO: 47
  dcFVIII/D'D3/D'D3-HC Light chain

SEQ ID NO: 70 - DNA, 8172 bp, Artificial Sequence
  scFVIII/D'D3/Fc/Fc-120
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagtactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatctatcaacgcatggagcaccaaggagccattctcctggatcaaggtggacctcctcgctcctatgatcatccacggcatcaagacccagggcgctagacagaagttcagcagcctctacatctcccagttcatcatcatgtactccctggacggcaagaagtggcagacctaccgcggaaactccaccggaaccctcatggtcttcttcggaaacgtggacagctccggtatcaagcacaacatcttcaacccccctatcatcgcacgttacatccgtctgcaccctacccactactccatcaggagcaccctcagaatggagctgatgggttgcgacctcaactcctgctccatgccactcggaatggagtcaaaggcaatctccgacgcacaaatcaccgcatcctcctacttcaccaacatgttcgccacctggtcaccaagtaaggcaaggctccacctccaaggacgttcaaacgcatggcgtccacaagtcaacaacccaaaggagtggctccaagtggacttccagaagacaatgaaggtgaccggcgtgaccacccaaggagtcaagtcactgctcacctccatgtacgtcaaggagttcctgatctccagctcccaagacggccaccaatggacccttttcttccagaacggcaaggtgaaggtcttccagggtaaccaggactccttcaccccagtcgtcaactccctcgatccaccacttcttaccagatacctccgaatccaccctcaaagctgggtccaccaaatcgcacttcgaatggaggtcctgggatgcgaagcacaagatctgtacctggtcccacgtggaagtggtggtgggggaagtggtggaggtggtagtggaggtggaggatctggtggtggaggttcaggtggagggggaagtggaggtggtgggtctggtggaggaggtagtggtggcggaggttctggaggtgggggatcaggtggtggaggatcaggaggaggtggatcaggtgggggaggatcaggcggaggtggttctggagggggtgggagtggaggaggcggatcaggaggcggtggctcaggaggaggcggctcaggaggcggaggatctgggggagggggctcaggaggtgggggttcagggggcggtggttctgggggcggggggtctggcggcggaggctctctttcatgtcgaccacctatggttaaacttgtatgtcctgcagataatcttagagctgaagggcttgaatgtacaaaaacttgtcaaaattatgatcttgaatgtatgtcaatggggtgtgttagtgggtgtctttgtcctcctgggatggttagacatgaaaatcgatgtgtagctttggaaagatgtccatgttttcatcaaggcaaagaatatgcaccaggcgaaacagtaaaaattgggtgtaatacatgtgtatgtcgagatcgaaaatggaattgtactgatcatgtttgtgatgcaacctgtagtaccatcggcatggctcactaccttaccttcgacgggttgaagtacctgttccctggggaatgccagtacgtactcgtccaggattactgcgggtctaaccctgggacatttagaattctggtcggcaacaagggctgctcccacccaagtgtcaagtgcaagaagagggtcaccattctggtcgagggcggcgaaatagaactgttcgacggggaagtaaacgtgaagaggccaatgaaggacgagacccacttcgaggtggtggaatccgggagatacattattctgctcctcgggaaggccctgagtgtcgtatgggacaggcacctttccattagcgtcgtcctcaagcagacctaccaggaaaaggtctgcggcctttgtgggaactttgacggcatacagaacaacgacctgacctccagcaacctgcaggtagaggaagacccagtagactttgggaacagctggaaggtctcctcccagtgtgctgacaccaggaaggtccctcttgactctagtccagctacctgtcacaacaacattatgaagcagaccatggtggacagcagctgccggattctcacttccgacgtgtttcaggactgcaacaagctggttgaccctgagccctacctggacgtgtgtatttacgacacatgctcctgcgagagcattggcgactgcgcttgcttttgcgacacaatagccgcctatgcccacgtgtgtgctcagcacggcaaagtggtgacttggaggacagctacactgtgtcctcagagttgtgaggagaggaacctgcgggaaaatggctatgagtgcgaatggcggtataatagctgcgccccagcttgtcaggtgacttgtcagcacccagaaccactggcttgtcctgtgcagtgtgttgaaggctgccatgctcattgcccaccaggcaaaattctggacgaactgctgcagacatgcgttgatcctgaggattgccctgtatgcgaagtggctggccggcggtttgcttctggcaaaaaagttactctgaatccctccgatcctgagcactgccagatatgccattgcgatgtggtgaatctgacttgcgaggcctgccaggaacctgggggcttggttgttcctcctacagatgcccctgttagtcctactactctgtatgtggaggatattagcgagccccctctgcatgattttggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 71 - DNA, 5106 bp, Artificial Sequence
  dcFVIII/D'D3/Fc-HC/Fc-LC Heavy chain
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttcggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 72 - DNA, 3093 bp, Artificial Sequence
  dcFVIII/D'D3/Fc-HC/Fc-LC light chain
gccaccgatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggtcccacgtggaagtggcggtggggggtcaggcggaggcggcagtggcggcgggggctctggcggaggtggcagtggcgggggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 73 - DNA, 5106 bp, Artificial Sequence; identical to SEQ ID NO: 71
  dcFVIII/D'D3/Fc-HC, Fc Heavy chain

SEQ ID NO: 74 - DNA, 2322 bp, Artificial Sequence; identical to SEQ ID NO: 47
  dcFVIII/D'D3/Fc-HC, Fc Light chain

SEQ ID NO: 75 - DNA, 5877 bp, Artificial Sequence
  dcFVIII/D'D3/Fc/Fc-HC Heavy chain
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaatgtcaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttcggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 76 - DNA, 2322 bp, Artificial Sequence; identical to SEQ ID NO: 47
  dcFVIII/D'D3/Fc/Fc-HC Light chain

SEQ ID NO: 77 - DNA, 4335 bp, Artificial Sequence; identical to SEQ ID NO: 46
  dcFVIII/D'D3-HC/Fc-LC Heavy chain

SEQ ID NO: 78 - DNA, 3093 bp, Artificial Sequence; identical to SEQ ID NO: 72
  dcFVIII/D'D3-HC/Fc-LC Light chain

SEQ ID NO: 79 - DNA, 4335 bp, Artificial Sequence; identical to SEQ ID NO: 46
  dcFVIII/D'D3-HC/Fc/Fc-LC Heavy chain

SEQ ID NO: 80 - DNA, 3864 bp, Artificial Sequence
  dcFVIII/D'D3-HC/Fc/Fc-LC Light chain
gccaccgatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacctggtcccacgtggaagtggcggtggggggtcaggcggaggcggcagtggcggcgggggctctggcggaggtggcagtggcgggggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggcggtggggggtcaggcggaggcggcagtggcggcgggggctctggcggaggtgggtccggcggtggcggttctggcgggggcggctctgacaaaactcacacatgcccaccgtgcccagcacctgaactccttgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 81 - protein, 5 aa, Artificial Sequence
  linker
GGGGS

SEQ ID NO: 82 - protein, 8 aa, Artificial Sequence
  C-terminal of 196-residue-long B-domain
SGGPLSLS

SEQ ID NO: 83 - protein, 15 aa, Artificial Sequence
  N-terminal of D' domain
SLSCRPPMVKLVCPA

The invention claimed is:

1. A chimeric protein comprising:
   (a) a mutated human Factor VIII (FVIII) comprising domains A1-A2-B-A3-C1-C2 of human FVIII, wherein the mutated human FVIII comprises mutations (i) and (ii), with respect to wild type human FVIII comprising SEQ ID NO: 1, wherein:
      (i) is a partial deletion of the B domain in the A1-A2-B-A3-C1-C2 domains of SEQ ID NO: 1, and
      (ii) is a substitution at position 782 of SEQ ID NO: 1 with cysteine;
   (b) at least one vWF (von Willebrand factor) fragment, said vWF fragment consisting of a D'D3 domain of the sequence of consecutive amino acids from position 742 to position 1248 of SEQ ID NO: 2; and
   (c) a linker connecting the (a) mutated human FVIII and the (b) vWF D'D3 domain, wherein the B domain consists of the sequence of consecutive amino acid residues from positions 741 to 902 and 1654 to 1689 of SEQ ID NO: 1,
   wherein the linker has an enzyme cleavage site,
   wherein the (a) mutated human FVIII is conjugated to a hydrophilic polymer at the cysteine at position 782 of SEQ ID NO: 1,
   wherein the hydrophilic polymer is polyethylene glycol (PEG), and the PEG is linked to the cysteine at position 782 of SEO ID NO: 1 via acryloyl, sulfone, or maleimide,
   wherein the PEG has an average molecular weight of 20 kDa or more,
   wherein the chimeric protein is in a single chain form, and
   wherein the chimeric protein does not comprise an Fc.

2. The chimeric protein of claim 1, wherein:
   the enzyme cleavage site of the (c) linker is an amino acid sequence which can be cleaved by thrombin, FVIIa, FXa, or FXIa,
      wherein the amino acid sequence which can be cleaved by the thrombin is DFLAEGGGVR (SEQ ID NO: 36), TTKIKPR (SEQ ID NO: 37), or LVPRGS (SEQ ID NO: 38); the amino acid sequence which can be cleaved by the FVIIa is ASKPQGRIVGG (SEQ ID NO:39); the amino acid sequence which can be cleaved by FXa is IDGR (SEQ ID NO: 40) or IEGR (SEQ ID NO: 41); the sequence which can be cleaved by FXIa is SKLTRAETVF (SEQ ID NO: 42); and
   wherein the (c) linker further comprises the amino acid sequence of [G$_4$S (SEQ ID NO: 81)]$_n$, wherein n is an integer between 1 and 100.

3. The chimeric protein of claim 2, wherein n is 4, 6, 8, 10, 16, 21, 22 or 58.

4. The chimeric protein of claim 1, wherein the chimeric protein comprises the amino acid sequence of SEQ ID NO: 6, 7, 8, 9, 10, 11, 12, 13, 14, 15, 16, 17, 18, or 19.

5. The chimeric protein of claim 1, wherein the (a) mutated human FVIII further comprises a substitution at one or more positions selected from the group consisting of 754, 781, 788, 789, 825, 897, 491, 495, 498, and 1806 of SEQ ID NO: 1 with cysteine.

6. The chimeric protein of claim 1, wherein the PEG has an average molecular weight of 40 kDa or 60 kDa.

7. The chimeric protein of claim 1, wherein the chimeric protein has at least a half-life which is extended by at least 2-fold as compared to a wild-type FVIII protein.

8. A nucleic acid molecule encoding the chimeric protein of claim 4.

9. The nucleic acid molecule of claim 8, wherein the nucleic acid molecule comprises the nucleic acid sequence of SEQ ID NO: 48, 49, 50, 51, 52, 53, 54, 55, 56, 57, 58, 59, 60, 61, 62, 63, or 64.

10. A vector comprising the nucleic acid molecule of claim 8.

11. An isolated cell comprising the vector of claim 10.

12. A pharmaceutical composition comprising the chimeric protein of claim 4, a nucleic acid molecule encoding the chimeric protein of claim 4, a vector comprising the nucleic acid encoding the chimeric protein of claim 4, or a cell carrying the vector comprising the nucleic acid encoding the chimeric protein of claim 4, and a pharmacologically acceptable carrier.

13. The pharmaceutical composition of claim 12, wherein the composition has a half-life wherein the composition can be administered once a day or longer.

14. A method for treating type A hemophilia in a subject in need thereof, comprising administering a therapeutically effective amount of the composition of claim 12 to the subject in need of hemophilia treatment.

15. A method of providing blood coagulation in a subject in need thereof, comprising administering an effective amount of the composition of claim 12 to the subject in need of blood coagulation.

\* \* \* \* \*